United States Patent 11,931,406 (FLAVIVIRUS VACCINE) - sequence listing, part 27

SEQ ID NO: 11314 - RNA, 9879 nt, Artificial Sequence
  derived and/or modified CDS sequence (opt2) from DENV-1__GU131780__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucuccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucaccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagaccaugaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11315 - RNA, 9879 nt, Artificial Sequence
  derived and/or modified CDS sequence (opt2) from DENV-1__GU131781__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggacaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugcauguccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11316 - RNA, 9879 nt, Artificial Sequence
  derived and/or modified CDS sequence (opt2) from DENV-1__GU131782__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggccucggcgaggucgacuccuucucccucggccuccucugcaucuccaucaugaucgaggaggucaugcgcucccgcuggucccgcaagaugcucauggccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagccccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagcgcugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11317 - RNA, 9879 nt, Artificial Sequence
  derived and/or modified CDS sequence (opt2) from DENV-1__GU131784__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccaccacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgcccgccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11318 - RNA, 9879 nt, Artificial Sequence
  derived and/or modified CDS sequence (opt2) from DENV-1__JF937612__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccauccgcgacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11319 - RNA, 9879 nt, Artificial Sequence
  derived and/or modified CDS sequence (opt2) from DENV-1__GU131786__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggcccccgcccgcggcgcccgccgcauggccauccucggcgccaccgccugggacuucggcuccaucggcggcgucuuccccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccgcgccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11320 - RNA, 9879 nt, Artificial Sequence
  derived and/or modified CDS sequence (opt2) from DENV-1__GU131787__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11321 - RNA, 9879 nt, Artificial Sequence
  derived and/or modified CDS sequence (opt2) from DENV-1__HM181968__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucgccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccuccuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccaucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11322 - RNA, 9879 nt, Artificial Sequence
  derived and/or modified CDS sequence (opt2) from DENV-1__GU131789__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccauccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11323 - RNA, 9879 nt, Artificial Sequence
  derived and/or modified CDS sequence (opt2) from DENV-1__GU131790__SS-prME
uccgucaccaugcuccucaugcucguccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagcucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucaagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11324 - RNA, 9879 nt, Artificial Sequence
  derived and/or modified CDS sequence (opt2) from DENV-1__GU131791__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggccccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucauccuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11325 - RNA, 9879 nt, Artificial Sequence
  derived and/or modified CDS sequence (opt2) from DENV-1__GU131792__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagcccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgccuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaccuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcuccccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccggccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucggcaccaacgagguccacaccuggaccgagcaguacaaguuccaggccgacucccccaagcgccucuccgccgccaucggcaagcccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauggccgccgccaucaaggaccgcaaggccguccacgccgacaugggcuacuggaucgaguccgagaagaacgagcccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucgcccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11326 - RNA, 9879 nt, Artificial Sequence
  derived and/or modified CDS sequence (opt2) from DENV-1__HM488256__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcuccccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgcccccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucugggccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagaucucccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcuccccuggaacgaccucauccgccucugcaucauggucggcgccaccgccuccgcccgcaugggcaugggcaccaccucccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugggccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11327 - RNA, 9879 nt, Artificial Sequence
  derived and/or modified CDS sequence (opt2) from DENV-1__GU131793__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaccacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacugcgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgacaagcagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11328 - RNA, 9879 nt, Artificial Sequence
  derived and/or modified CDS sequence (opt2) from DENV-1__GU131794__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccaucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11329 - RNA, 9879 nt, Artificial Sequence
  derived and/or modified CDS sequence (opt2) from DENV-1__GU131796__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccgaccccgccguccuccgcaagcucugcgucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuccucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccgccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11330 - RNA, 9879 nt, Artificial Sequence
  derived and/or modified CDS sequence (opt2) from DENV-1__GU131797__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacugcgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgacaagcagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11331 - RNA, 9879 nt, Artificial Sequence
  derived and/or modified CDS sequence (opt2) from DENV-1__GU131801__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucggcaucggcgccggcgagaaggcccucaagcucuccugggucaagaagggcuccuccaucggcaagauggucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11332 - RNA, 9879 nt, Artificial Sequence
  derived and/or modified CDS sequence (opt2) from DENV-1__GU131804__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggcccgcgccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaacaucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11333 - RNA, 9879 nt, Artificial Sequence
  derived and/or modified CDS sequence (opt2) from DENV-1__GU131805__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccgaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccucccccgagauccagcuccccgacuacggcgcccucacccucgacugcuccccccgccccggccucgacuucaacgagaugguccuccuccccaugaaggagaaguccuggcucguccacaagcagugguuccucgaccucccccuccccuggaccuccggcgccuccaccucccaggagaccuggaaccgcaaggaccuccucggcaccuucaagaccgcccacgccaaggagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagcccgccuucggcgaguccuacaucgucaucggcgccggcgagaaggcccucaagcucuccugggucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucggcaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgccaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagcccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccguccccggcaagaucauccacgaguggugcugccgcuccugcacccuccccccccuccgcuucaagggcgaggacggcugcugguacggcauggagaucucccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcccccuccccgucuucuuccuccucaucaugggccagcuccccuggaacgaccucauccgccucugcaucauggucggcgccaacgccuccgaccgcaugggcaugggcacccccuaccucgcccucauggccaccuucaagaugcgccccauguucgccgucggccuccucuuccgccgccucaccucccgcgagggccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucgcccucaccuucaucaagaccaccuucucccucgacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcggcucccacaacauccucgucgagguccaggacgacggcaccaugaagaucaaggacgaggagcgcgacgccacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccgccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11334 - RNA, 9879 nt, Artificial Sequence
  derived and/or modified CDS sequence (opt2) from DENV-1__GU131806__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccucgccuggaccuccggcggcuccaccucccaggagaccuggaaccgccaggaccucgucgucaccuucaagaccgcccacggcaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucgccaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggccccucccacaacauccucgucgagguccaggacgacggccccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagauccucggccucuacggcaacggcgucgucaccaccuccggcaccuacgucuccgccaucgcccaggcccgcgccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11335 - RNA, 9879 nt, Artificial Sequence
  derived and/or modified CDS sequence (opt2) from DENV-1__GU131807__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagcccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccucgucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggccccgccuacggcguccucuucuccggcgucuccuggcccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgaccacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagauccgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacugcgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagaagaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgacaagcagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11336 - RNA, 9879 nt, Artificial Sequence
  derived and/or modified CDS sequence (opt2) from DENV-1__GU131811__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaucggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgagaccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaaggucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11337 - RNA, 9882 nt, Artificial Sequence
  derived and/or modified CDS sequence (opt2) from DENV-1__JF937615__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccgaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccgacuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaucgacuuccagucccaccagcucugggccacccuccucucccucaccuucaucaagaccaccuucucccuccacuacgccuggaagaccauggccaugguccucuccaucgucucccucuucccccuccuccccguccacgaccuccccaagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccgcccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucauguuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccgccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11338 - RNA, 9879 nt, Artificial Sequence
  derived and/or modified CDS sequence (opt2) from DENV-1__GU131814__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacgaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11339 - RNA, 9879 nt, Artificial Sequence
  derived and/or modified CDS sequence (opt2) from DENV-1__GU131815__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucacccgccucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaccaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgccuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccgucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11340 - RNA, 9879 nt, Artificial Sequence
  derived and/or modified CDS sequence (opt2) from DENV-1__GU131818__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccagcacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucguccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccucccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccucaaggagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11341 - RNA, 9879 nt, Artificial Sequence
  derived and/or modified CDS sequence (opt2) from DENV-1__GU131820__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggccucggcgaggucgacuccuucucccucggccuccucugcaucuccaucaugaucgaggaggucaugcgcucccgcuggucccgcaagaugcucauggccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagcgcugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11342 - RNA, 9879 nt, Artificial Sequence
  derived and/or modified CDS sequence (opt2) from DENV-1__HM181970__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuucgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggaggacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggccacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11343 - RNA, 9879 nt, Artificial Sequence
  derived and/or modified CDS sequence (opt2) from DENV-1__GU131821__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccagcacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgaguggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11344 - RNA, 9879 nt, Artificial Sequence
  derived and/or modified CDS sequence (opt2) from DENV-1__JF937617__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggccucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaugggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgagaucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11345 - RNA, 9879 nt, Artificial Sequence
  derived and/or modified CDS sequence (opt2) from DENV-1__JF937618__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaacccccgcaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggaccgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11346 - RNA, 9879 nt, Artificial Sequence
  derived and/or modified CDS sequence (opt2) from DENV-1__JF937619__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggucaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaagaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucaucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11347 - RNA, 9879 nt, Artificial Sequence
  derived and/or modified CDS sequence (opt2) from DENV-1__GU131827__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguuccgcaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgccaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucguccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11348 - RNA, 9879 nt, Artificial Sequence
  derived and/or modified CDS sequence (opt2) from DENV-1__GU131831__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11349 - RNA, 9879 nt, Artificial Sequence
  derived and/or modified CDS sequence (opt2) from DENV-1__EU482789__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagauggagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggccgcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11350 - RNA, 9879 nt, Artificial Sequence
  derived and/or modified CDS sequence (opt2) from DENV-1__EU482790__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcuccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacguccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagguccccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11351 - RNA, 9879 nt, Artificial Sequence
  derived and/or modified CDS sequence (opt2) from DENV-1__EU482791__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11352 - RNA, 9879 nt, Artificial Sequence
  derived and/or modified CDS sequence (opt2) from DENV-1__EU482792__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11353 - RNA, 9879 nt, Artificial Sequence
  derived and/or modified CDS sequence (opt2) from DENV-1__EU482707__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgaggcccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11354 - RNA, 9879 nt, Artificial Sequence
  derived and/or modified CDS sequence (opt2) from DENV-1__EU482708__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucaucuccgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11355 - RNA, 9879 nt, Artificial Sequence
  derived and/or modified CDS sequence (opt2) from DENV-1__EU482709__SS-prME
uccgucaccaugcuccucaugcucguccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11356 - RNA, 9879 nt, Artificial Sequence
  derived and/or modified CDS sequence (opt2) from DENV-1__EU482710__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaagcacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucaucuccgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucaucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11357 - RNA, 9879 nt, Artificial Sequence
  derived and/or modified CDS sequence (opt2) from DENV-1__EU482712__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaacuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccguccucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11358 - RNA, 9879 nt, Artificial Sequence
  derived and/or modified CDS sequence (opt2) from DENV-1__EU249490__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgccgcaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11359 - RNA, 9879 nt, Artificial Sequence
  derived and/or modified CDS sequence (opt2) from DENV-1__EU249491__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11360 - RNA, 9879 nt, Artificial Sequence
  derived and/or modified CDS sequence (opt2) from DENV-1__EU249492__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgagguccagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcucccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgacacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccggccccgagggcgcccucugguga

SEQ ID NO: 11361 - RNA, 9879 nt, Artificial Sequence
  derived and/or modified CDS sequence (opt2) from DENV-1__EU249493__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgacaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11362 - RNA, 9879 nt, Artificial Sequence
  derived and/or modified CDS sequence (opt2) from DENV-1__EU249494__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacugcaugaccuccaugaagcgcuucaagaacgagggcgaccccgagggcgcccucugguga

SEQ ID NO: 11363 - RNA, 9879 nt, Artificial Sequence
  derived and/or modified CDS sequence (opt2) from DENV-1__EU249495__SS-prME
uccgucaccaugcuccucaugcucaugcccaccgcccucgccuuccaccucaccacccgcggcggcgagccccacaugaucgucaccaagcaggagcgcggcaagucccuccucuucaagaccaccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11364 - RNA, 9879 nt, Artificial Sequence
  derived and/or modified CDS sequence (opt2) from DENV-1__EU482794__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgccucccucuucccccucugccucuccaccaccucccagaagaccaccuggcuccccguccuccucggcucccucggcugcaagccccucaccauguuccucaucaccgagaccaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgucguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaacuacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11365 - RNA, 9879 nt, Artificial Sequence
  derived and/or modified CDS sequence (opt2) from DENV-1__EU482795__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucuccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgccgcaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11366 - RNA, 9879 nt, Artificial Sequence
  derived and/or modified CDS sequence (opt2) from DENV-1__EU482796__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11367 - RNA, 9879 nt, Artificial Sequence
  derived and/or modified CDS sequence (opt2) from DENV-1__EU482797__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11368 - RNA, 9879 nt, Artificial Sequence
  derived and/or modified CDS sequence (opt2) from DENV-1__EU482799__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgucaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagauccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11369 - RNA, 9879 nt, Artificial Sequence
  derived and/or modified CDS sequence (opt2) from DENV-1__EU482800__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggccagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaucgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugguccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcgucuucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11370 - RNA, 9879 nt, Artificial Sequence
  derived and/or modified CDS sequence (opt2) from DENV-1__EU482801__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11371 - RNA, 9879 nt, Artificial Sequence
  derived and/or modified CDS sequence (opt2) from DENV-1__EU482802__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgccgcaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaguccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11372 - RNA, 9879 nt, Artificial Sequence
  derived and/or modified CDS sequence (opt2) from DENV-1__EU482804__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaaggucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccaccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaccggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11373 - RNA, 9879 nt, Artificial Sequence
  derived and/or modified CDS sequence (opt2) from DENV-1__EU482806__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccugcgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11374 - RNA, 9879 nt, Artificial Sequence
  derived and/or modified CDS sequence (opt2) from DENV-1__EU482807__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucgucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11375 - RNA, 9879 nt, Artificial Sequence
  derived and/or modified CDS sequence (opt2) from DENV-1__EU482808__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcgacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11376 - RNA, 9879 nt, Artificial Sequence
  derived and/or modified CDS sequence (opt2) from DENV-1__EU482809__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11377 - RNA, 9879 nt, Artificial Sequence
  derived and/or modified CDS sequence (opt2) from DENV-1__EU482810__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgagguccagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucucccacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcucccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgacacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccggccccgagggcgcccucugguga

SEQ ID NO: 11378 - RNA, 9879 nt, Artificial Sequence
  derived and/or modified CDS sequence (opt2) from DENV-1__EU482811__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauccacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccaacgagcucgagacccccaaccucgccggccgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11379 - RNA, 9879 nt, Artificial Sequence
  derived and/or modified CDS sequence (opt2) from DENV-1__EU482812__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11380 - RNA, 9879 nt, Artificial Sequence
  derived and/or modified CDS sequence (opt2) from DENV-1__EU482813__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgaggaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11381 - RNA, 9879 nt, Artificial Sequence
  derived and/or modified CDS sequence (opt2) from DENV-1__EU482814__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggcuucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11382 - RNA, 9879 nt, Artificial Sequence
  derived and/or modified CDS sequence (opt2) from DENV-1__EU482815__SS-prME
uccgucaccaugcuccucaugcucaugcccgccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaccgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguucuucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11383 - RNA, 9879 nt, Artificial Sequence
  derived and/or modified CDS sequence (opt2) from DENV-1__EU482816__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11384 - RNA, 9879 nt, Artificial Sequence
  derived and/or modified CDS sequence (opt2) from DENV-1__EU482821__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11385 - RNA, 9879 nt, Artificial Sequence
  derived and/or modified CDS sequence (opt2) from DENV-1__EU482822__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacuccauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11386 - RNA, 9879 nt, Artificial Sequence
  derived and/or modified CDS sequence (opt2) from DENV-1__EU482476__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaccuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucgccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11387 - RNA, 9879 nt, Artificial Sequence
  derived and/or modified CDS sequence (opt2) from DENV-1__EU482477__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccaugcucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuacucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11388 - RNA, 9879 nt, Artificial Sequence
  derived and/or modified CDS sequence (opt2) from DENV-1__EU482478__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11389 - RNA, 9879 nt, Artificial Sequence
  derived and/or modified CDS sequence (opt2) from DENV-1__EU482479__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaucugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucgucgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucaagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11390 - RNA, 9879 nt, Artificial Sequence
  derived and/or modified CDS sequence (opt2) from DENV-1__EU482480__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcacccagaucggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgccacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaagaucuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11391 - RNA, 9879 nt, Artificial Sequence
  derived and/or modified CDS sequence (opt2) from DENV-1__EU482481__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucaucuccgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucaucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11392 - RNA, 9879 nt, Artificial Sequence
  derived and/or modified CDS sequence (opt2) from DENV-1__EU482482__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11393 - RNA, 9879 nt, Artificial Sequence
  derived and/or modified CDS sequence (opt2) from DENV-1__EU482485__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccaccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccgucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11394 - RNA, 9879 nt, Artificial Sequence
  derived and/or modified CDS sequence (opt2) from DENV-1__EU482486__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccucuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgacuccgaccccgagggcgcccucugguga

SEQ ID NO: 11395 - RNA, 9879 nt, Artificial Sequence
  derived and/or modified CDS sequence (opt2) from DENV-1__EU482487__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgccaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucaagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11396 - RNA, 9879 nt, Artificial Sequence
  derived and/or modified CDS sequence (opt2) from DENV-1__EU482488__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11397 - RNA, 9879 nt, Artificial Sequence
  derived and/or modified CDS sequence (opt2) from DENV-1__EU482489__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucacccucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11398 - RNA, 9879 nt, Artificial Sequence
  derived and/or modified CDS sequence (opt2) from DENV-1__EU482490__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaccaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11399 - RNA, 9879 nt, Artificial Sequence
  derived and/or modified CDS sequence (opt2) from DENV-1__EU482491__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcacccagaucggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgccacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaagaucuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11400 - RNA, 9879 nt, Artificial Sequence
  derived and/or modified CDS sequence (opt2) from DENV-1__EU482493__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11401 - RNA, 9879 nt, Artificial Sequence
  derived and/or modified CDS sequence (opt2) from DENV-1__EU482494__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaucaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgccacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccuccgcggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11402 - RNA, 9879 nt, Artificial Sequence
  derived and/or modified CDS sequence (opt2) from DENV-1__EU482495__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggccucuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgcccgcaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucuccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgacuccgaccccgagggcgcccucugguga

SEQ ID NO: 11403 - RNA, 9879 nt, Artificial Sequence
  derived and/or modified CDS sequence (opt2) from DENV-1__EU482496__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucaagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11404 - RNA, 9879 nt, Artificial Sequence
  derived and/or modified CDS sequence (opt2) from DENV-1__EU482497__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccagggcaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaccauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11405 - RNA, 9879 nt, Artificial Sequence
  derived and/or modified CDS sequence (opt2) from DENV-1__EU482499__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucaagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11406 - RNA, 9879 nt, Artificial Sequence
  derived and/or modified CDS sequence (opt2) from DENV-1__EU482500__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggaggccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11407 - RNA, 9879 nt, Artificial Sequence
  derived and/or modified CDS sequence (opt2) from DENV-1__EU482501__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11408 - RNA, 9879 nt, Artificial Sequence
  derived and/or modified CDS sequence (opt2) from DENV-1__EU482504__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggucacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucaucuccgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11409 - RNA, 9879 nt, Artificial Sequence
  derived and/or modified CDS sequence (opt2) from DENV-1__EU482505__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaggccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacaccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucaaccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaucgaccccgagggcgcccucugguga

SEQ ID NO: 11410 - RNA, 9879 nt, Artificial Sequence
  derived and/or modified CDS sequence (opt2) from DENV-1__EU482506__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11411 - RNA, 9879 nt, Artificial Sequence
  derived and/or modified CDS sequence (opt2) from DENV-1__EU482509__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgccggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucguccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaucaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgagcccgagggcgcccucugguga

SEQ ID NO: 11412 - RNA, 9879 nt, Artificial Sequence
  derived and/or modified CDS sequence (opt2) from DENV-1__EU482510__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggucgagcccgacgacgucgacugcuggugcaacaccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccuccgcaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacggcaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggcgccagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccuccucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggaucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccuccgccgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11413 - RNA, 9879 nt, Artificial Sequence
  derived and/or modified CDS sequence (opt2) from DENV-1__EU482511__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaugucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11414 - RNA, 9879 nt, Artificial Sequence
  derived and/or modified CDS sequence (opt2) from DENV-1__EU482513__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11415 - RNA, 9879 nt, Artificial Sequence
  derived and/or modified CDS sequence (opt2) from DENV-1__EU482515__SS-prME
uccgucaccacccuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaugucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcugguccaagaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11416 - RNA, 9879 nt, Artificial Sequence
  derived and/or modified CDS sequence (opt2) from DENV-1__EU482516__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11417 - RNA, 9879 nt, Artificial Sequence
  derived and/or modified CDS sequence (opt2) from DENV-1__EU482517__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaacaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgccgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggacuccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11418 - RNA, 9879 nt, Artificial Sequence
  derived and/or modified CDS sequence (opt2) from DENV-1__EU482519__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaaggucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11419 - RNA, 9879 nt, Artificial Sequence
  derived and/or modified CDS sequence (opt2) from DENV-1__EU482520__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugcgcgagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacggccacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcauccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11420 - RNA, 9879 nt, Artificial Sequence
  derived and/or modified CDS sequence (opt2) from DENV-1__EU482521__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggccgcauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggcgcuccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacaucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaucaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11421 - RNA, 9879 nt, Artificial Sequence
  derived and/or modified CDS sequence (opt2) from DENV-1__EU482523__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccaggccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgccgcaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11422 - RNA, 9879 nt, Artificial Sequence
  derived and/or modified CDS sequence (opt2) from DENV-1__EU482525__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccuccuucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucggccagggcaagaagaugauccgcccccagcccauggaguacaaguacuccuggaaguccuggggcaaggccaagaucaucggcgccgacgcccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccgcggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcaccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaaguacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagaccgaccccgagggcgcccucugguga

SEQ ID NO: 11423 - RNA, 9879 nt, Artificial Sequence
  derived and/or modified CDS sequence (opt2) from DENV-1__EU482526__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagauccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacgucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11424 - RNA, 9879 nt, Artificial Sequence
  derived and/or modified CDS sequence (opt2) from DENV-1__EU482527__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacggcaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuucgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11425 - RNA, 9879 nt, Artificial Sequence
  derived and/or modified CDS sequence (opt2) from DENV-1__EU482528__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgccaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaagcacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcggcaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11426 - RNA, 9879 nt, Artificial Sequence
  derived and/or modified CDS sequence (opt2) from DENV-1__EU482529__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccacccuccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucaucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11427 - RNA, 9879 nt, Artificial Sequence
  derived and/or modified CDS sequence (opt2) from DENV-1__EU482531__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccaacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11428 - RNA, 9879 nt, Artificial Sequence
  derived and/or modified CDS sequence (opt2) from DENV-1__EU482532__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccaccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgcuccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11429 - RNA, 9879 nt, Artificial Sequence
  derived and/or modified CDS sequence (opt2) from DENV-1__EU482533__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaccguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucaucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11430 - RNA, 9879 nt, Artificial Sequence
  derived and/or modified CDS sequence (opt2) from DENV-1__EU482534__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucguccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11431 - RNA, 9879 nt, Artificial Sequence
  derived and/or modified CDS sequence (opt2) from DENV-1__EU482535__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagaugcgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagccccgcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacaucgacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccguccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucgucaagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11432 - RNA, 9879 nt, Artificial Sequence
  derived and/or modified CDS sequence (opt2) from DENV-1__EU482536__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacaugcucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11433 - RNA, 9879 nt, Artificial Sequence
  derived and/or modified CDS sequence (opt2) from DENV-1__EU482537__SS-prME
uccgucaccaugcuccucaugcucaugcccaccgcccucgccuuccaccucaccacccgcggcggcgagccccacaugaucgucaccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucauggaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucauccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgucggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggccugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcgucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccacccgccacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccagaaggagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccuggggcgacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgagggcgaccccgagggcgcccucugguga

SEQ ID NO: 11434 - RNA, 9879 nt, Artificial Sequence
  derived and/or modified CDS sequence (opt2) from DENV-1__EU482538__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgaccgcgagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccucgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgccgccuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgaccgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11435 - RNA, 9879 nt, Artificial Sequence
  derived and/or modified CDS sequence (opt2) from DENV-1__EU482539__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcacccuccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaacauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11436 - RNA, 9879 nt, Artificial Sequence
  derived and/or modified CDS sequence (opt2) from DENV-1__KP188539__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaucaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgagauggacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaaggacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccuccgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaccaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11437 - RNA, 9879 nt, Artificial Sequence
  derived and/or modified CDS sequence (opt2) from DENV-1__KP188540__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcaugcucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgccacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11438 - RNA, 9879 nt, Artificial Sequence
  derived and/or modified CDS sequence (opt2) from DENV-1__KP188541__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguucuucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgagaacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccgucgaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11439 - RNA, 9879 nt, Artificial Sequence
  derived and/or modified CDS sequence (opt2) from DENV-1__KP188543__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggucgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgagauggacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucgucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggagaacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11440 - RNA, 9879 nt, Artificial Sequence
  derived and/or modified CDS sequence (opt2) from DENV-1__KP188544__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccugccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucaugcaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcaccacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11441 - RNA, 9879 nt, Artificial Sequence
  derived and/or modified CDS sequence (opt2) from DENV-1__KP188547__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugaucaagccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgcccucgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccuccucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcacccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11442 - RNA, 9879 nt, Artificial Sequence
  derived and/or modified CDS sequence (opt2) from DENV-1__KP723473__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagugcgacucccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcauccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcaccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11443 - RNA, 9879 nt, Artificial Sequence
  derived and/or modified CDS sequence (opt2) from DENV-1__KT187564__SS-prME
uccgucaccaugcuccucaugcucaugcccaccgcccucgccuuccaccucaccacccgcggcggcgagccccacaugauggucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaagggcaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaucggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuucccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccgccucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccaacugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11444 - RNA, 9879 nt, Artificial Sequence
  derived and/or modified CDS sequence (opt2) from DENV-1__KT187560__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11445 - RNA, 9879 nt, Artificial Sequence
  derived and/or modified CDS sequence (opt2) from DENV-1__KT187561__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuuccucauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11446 - RNA, 9879 nt, Artificial Sequence
  derived and/or modified CDS sequence (opt2) from DENV-1__KT187562__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11447 - RNA, 9879 nt, Artificial Sequence
  derived and/or modified CDS sequence (opt2) from DENV-1__JQ045628__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccucgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucaucgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11448 - RNA, 9879 nt, Artificial Sequence
  derived and/or modified CDS sequence (opt2) from DENV-1__JQ045629__SS-prME
uccgucaccaugcuccucaugcucaugcccaccgcccucgccuuccaccucaccacccgcggcggcgagccccacaugauggucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11449 - RNA, 9879 nt, Artificial Sequence
  derived and/or modified CDS sequence (opt2) from DENV-1__JQ045630__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucaucgccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11450 - RNA, 9879 nt, Artificial Sequence
  derived and/or modified CDS sequence (opt2) from DENV-1__JQ045632__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccaucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccucaagaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucauccuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11451 - RNA, 9879 nt, Artificial Sequence
  derived and/or modified CDS sequence (opt2) from DENV-1__JQ045633__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucgccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccagaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggucucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaguacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11452 - RNA, 9879 nt, Artificial Sequence
  derived and/or modified CDS sequence (opt2) from DENV-1__JQ045634__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucgccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcgccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccagaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggucucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaguacgccgucucccgcggcaccgccaagcuccgcugguucgucgagcgcaaccucgucaagcccgagggcaaggucaucgaccucggcugcggccgcggcggcugggccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11453 - RNA, 9879 nt, Artificial Sequence
  derived and/or modified CDS sequence (opt2) from DENV-1__JQ045636__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccgacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgaccccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11454 - RNA, 9879 nt, Artificial Sequence
  derived and/or modified CDS sequence (opt2) from DENV-1__JQ045635__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaucgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccgacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucauccgcaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgucgucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgaccccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugggccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccuccucggcaacgagaacuaccucgacuacaugaccuccaugaagcgcuucaagaacgaguccgaccccgagggcgcccucugguga

SEQ ID NO: 11455 - RNA, 9879 nt, Artificial Sequence
  derived and/or modified CDS sequence (opt2) from DENV-1__JQ045637__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagauguccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacucccucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccgccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccaucgaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11456 - RNA, 9879 nt, Artificial Sequence
  derived and/or modified CDS sequence (opt2) from DENV-1__JQ045638__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagauguccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacucccucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccgccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccaucgaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugggccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11457 - RNA, 9879 nt, Artificial Sequence
  derived and/or modified CDS sequence (opt2) from DENV-1__JQ045639__SS-prME
uccgucaccauguuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucuggcacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggcccgcgccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggccgcugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11458 - RNA, 9879 nt, Artificial Sequence
  derived and/or modified CDS sequence (opt2) from DENV-1__JQ045641__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucgcccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacaccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11459 - RNA, 9879 nt, Artificial Sequence
  derived and/or modified CDS sequence (opt2) from DENV-1__JQ045642__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccagugcgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11460 - RNA, 9879 nt, Artificial Sequence
  derived and/or modified CDS sequence (opt2) from DENV-1__JQ045644__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccgccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgcccgcuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11461 - RNA, 9879 nt, Artificial Sequence
  derived and/or modified CDS sequence (opt2) from DENV-1__JQ045648__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucgcccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccacccucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacaccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccaccugcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11462 - RNA, 9879 nt, Artificial Sequence
  derived and/or modified CDS sequence (opt2) from DENV-1__JQ045649__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccguccgcgagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccucccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccucaagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccuccacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11463 - RNA, 9879 nt, Artificial Sequence
  derived and/or modified CDS sequence (opt2) from DENV-1__JQ045650__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccguccgcgagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccucccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugggccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccucaagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccuccacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11464 - RNA, 9879 nt, Artificial Sequence
  derived and/or modified CDS sequence (opt2) from DENV-1__JQ045651__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaguacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11465 - RNA, 9879 nt, Artificial Sequence
  derived and/or modified CDS sequence (opt2) from DENV-1__JQ045652__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaguacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11466 - RNA, 9879 nt, Artificial Sequence
  derived and/or modified CDS sequence (opt2) from DENV-1__JQ045653__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcugguccaagaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacugcgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggaggacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11467 - RNA, 9879 nt, Artificial Sequence
  derived and/or modified CDS sequence (opt2) from DENV-1__JQ045657__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgcaaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccaccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccggccgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11468 - RNA, 9879 nt, Artificial Sequence
  derived and/or modified CDS sequence (opt2) from DENV-1__JQ045659__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgccgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccauggagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagaaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagcgcccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11469 - RNA, 9879 nt, Artificial Sequence
  derived and/or modified CDS sequence (opt2) from DENV-1__JQ045661__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucgucggccagcucaccuggaacgaccucauccgccucugcaucaugaucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccgucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaaguacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11470 - RNA, 9879 nt, Artificial Sequence
  derived and/or modified CDS sequence (opt2) from DENV-1__JQ045663__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccuccacccccgagugccccgacgaccagcgcgccuggaacaucugggaggucgaggacuacggcuucggcaucuucaccaccaacaucuggcucaagcuccgcgacucccacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaacuccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuuccuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11471 - RNA, 9879 nt, Artificial Sequence
  derived and/or modified CDS sequence (opt2) from DENV-1__JQ045665__SS-prME
uccgucaccaugcuccucaugcucaugcccaccgcccucgccuuccaccucaccgcccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucaacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgccucucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccaccacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaaguccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgccgccacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccaccugcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11472 - RNA, 9879 nt, Artificial Sequence
  derived and/or modified CDS sequence (opt2) from DENV-1__JQ045666__SS-prME
uccgucaccaugcuccucaugcucaugcccaccgcccucgccuuccaccucaccgcccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggagcucgccgagacccagcacggcaccguccucguccagaucaaguacgagggcaccgacgcccccugcaagauccccuucuccacccaggacgagaagggcgccacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucaacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgccucucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccaccacgccuggaagaccauggccaugauccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaaguccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgccgccacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11473 - RNA, 9879 nt, Artificial Sequence
  derived and/or modified CDS sequence (opt2) from DENV-1__JQ045667__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccaacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaagggcaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccaguccuaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucauggccugcuacgucaucuccggcuccuccgccgaccucucccucgagaaggccgccgaggucuccugggaggaggaggccgagcacuccggcgccucccacaacauccucgucgagguccagggcgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucggccgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccauccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11474 - RNA, 9879 nt, Artificial Sequence
  derived and/or modified CDS sequence (opt2) from DENV-1__KU094071__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccaaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcggcaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaagcgcaaguccuggcucguccacaagcagugguuccucgaccucccccuccccuggaccuccggcgccuccaccccccaggagaccuggaaccgcgaggaccuccucgucaccuucaagaccgcccacgccaagaagcaggaggucgucguccucggcucccaggagggcgccaugcacaccgcccucaccggcgccaccgagauccagaccuccggcaccaccaagaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagaugcucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccgcgccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucacccagggccgcaagaugaucggcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgacccccgccucauguccgccgccaucaaggacuccaaggccguccacgccgacaugggcuacuggaucgaguccgagaagaacgagaccuggcgccucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuccacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggacaaggaggagaaccucgucaagucccucgucuccgccggcuccggcgaggucgacuccuucucccucggccuccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucaucgccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccgcccuccucucccucaccuucaucaagaccaccuucucccuccacuacgccuggaagaccauggccaugguccucuccaccgucucccucuucccccucugccucuccaccaccucccgcaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccaucuccauccccgccacccucuucgucugguacuuccgccagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgucaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugcuccaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcggcaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgcaaguggugcuucgacggcgagcgcaacaaccagguccucgaggagaacauggacgucgagaucuggaccaaggagggcgagcgcaagaagcuccgcccccgcuggcucgacgcccgcaccuacuccgacccccaggcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucugggucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccccacccucaucgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccucuccaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucccccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccaucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaaggacgaguccgaccucgagggcgcccucugguga

SEQ ID NO: 11475 - RNA, 9879 nt, Artificial Sequence
  derived and/or modified CDS sequence (opt2) from DENV-1__HQ624983__SS-prME
uccgucaccaugcuccucaugcucguccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgaguucugcgaggacaccaugaccuacaagugcccccgcaucuccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccuccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaugaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccaccucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaacuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccgccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11476 - RNA, 9879 nt, Artificial Sequence
  derived and/or modified CDS sequence (opt2) from DENV-1__FJ384655__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucgccucccgcgagguccuccuccucaccaucggccucucccucgucgccuccgucgagcuccccaacucccucgaggagcucggcgacggccucgccaugggcaucaugaugcucaagcuccucaccgaguuccagccccaccaccucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcgccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagggcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucucccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcggcuaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11477 - RNA, 9879 nt, Artificial Sequence
  derived and/or modified CDS sequence (opt2) from DENV-1__KC759167__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccgucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggcccccgaggucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccaagccccccuucggcgaguccugcaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcaccccccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcgcccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgcaagcucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcgcaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgagggcguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgaguacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuacgucgagcucaugcgccgcggcgaccuccccgucuggcucuccuacaaggucgccuccgagggcuuccaguacuccgaccgccgcugguacuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagcucgaguucaacuccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccuccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccgagcgcguccucgacuggcucgagaaguacggcaucgagcgccucaagcgcauggccaucuccggcgacgacugcgucgucaagcccaucgacaaccgcuucgccaccgcccucaccgcccucaacgacaugggcaagguccgcaaggacaucccccagugggagcccuccaagggcuggaacgacuggcagcaggucccccucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11478 - RNA, 9879 nt, Artificial Sequence
  derived and/or modified CDS sequence (opt2) from DENV-1__JQ048541__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaagcuccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgcuccugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggggccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11479 - RNA, 9879 nt, Artificial Sequence
  derived and/or modified CDS sequence (opt2) from DENV-1__JN697056__SS-prME
uccgucaccaugcuccucaugcuccuccccaccgcccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacaucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggccccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcaugaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaaguccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcugguccaagaagaugcucaugaccggcacccucgccgucuuccuccuccucaccaugggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugauccucaagcuccucaccgacuuccagucccaccagcucugggccacccuccucucccucaccuucgucaagaccaccuucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucugguacuucuggcagaagcgcaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccucgacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauguccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucgucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacaugggcgcccagcucauccgccagauggaguccgagggcaucuuccuccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11480 - RNA, 9879 nt, Artificial Sequence
  derived and/or modified CDS sequence (opt2) from DENV-1__JN697057__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaucugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaaggucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggucacccuccucucccucaccuucaucaagaccgccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagcgcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgccgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucgucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccaagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11481 - RNA, 9879 nt, Artificial Sequence
  derived and/or modified CDS sequence (opt2) from DENV-1__HQ624984__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgaguccgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgcccucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucggcaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaccgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11482 - RNA, 9879 nt, Artificial Sequence
  derived and/or modified CDS sequence (opt2) from DENV-1__HQ891314__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaccgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11483 - RNA, 9879 nt, Artificial Sequence
  derived and/or modified CDS sequence (opt2) from DENV-1__HQ891315__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccaucgucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11484 - RNA, 9879 nt, Artificial Sequence
  derived and/or modified CDS sequence (opt2) from DENV-1__HQ891316__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11485 - RNA, 9879 nt, Artificial Sequence
  derived and/or modified CDS sequence (opt2) from DENV-1__JN054256__SS-prME
uccgucaccaugcuccucaugcucaugcccaccgcccucgccuuccaccucaccacccgcgagggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaccgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaagcucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaucgacuuccagucccaccagcucugggccacccuccucuccaugaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11486 - RNA, 9879 nt, Artificial Sequence
  derived and/or modified CDS sequence (opt2) from DENV-1__JN054255__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagauguccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagaaggccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccggcaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgagaaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcauggucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccuccaagaacggcaccgucauggacgucaucucccgccgcgaccagcgcggcuccggccaggucggcaccuacggccucaacaccuucaccaacauggaggcccagcucauccgccagauggaguccgaggagaucuucucccccaacgagcucgagacccccaaccucgccaagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11487 - RNA, 9879 nt, Artificial Sequence
  derived and/or modified CDS sequence (opt2) from DENV-1__KP406801__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacaccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucgccggcgccaccgagauccagauguccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccauccaggacgagaagggcgucacccagaacggccgccucaucaccgccaaccccaucgccaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccaucgccaugguccucuccaucgucucccucuucccccucugccucuccaccaccucccagaagaccaccuggcuccccguccuccucggcuccuucggcugcaagccccucaccauguuccucaucaccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucguccgccccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagaaguucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11488 - RNA, 9879 nt, Artificial Sequence
  derived and/or modified CDS sequence (opt2) from DENV-1__KP406802__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcaucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaucuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11489 - RNA, 9879 nt, Artificial Sequence
  derived and/or modified CDS sequence (opt2) from DENV-1__KP406803__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucaacggcauccucgcccagggcaagaagaugauccgcccccagcccauggagcacaaguacuccuggaaguccuggggcaaggccaaggucaucggcgccgacguccagaacaucaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucacccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucggccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccgcccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcauccccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagucccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccuccgcauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11490 - RNA, 9879 nt, Artificial Sequence
  derived and/or modified CDS sequence (opt2) from DENV-1__KJ438293__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaugaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagaucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccggcuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucguccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggaucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccauccucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacuggaucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11491 - RNA, 9879 nt, Artificial Sequence
  derived and/or modified CDS sequence (opt2) from DENV-1__KJ438296__SS-prME
uccgucaccaugcuccucaugcucaugcccaccgcccucgccuuccaccucaccacccgcggcggcgagccccacaugauggucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaucggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgccgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuucccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccgccucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccaacugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11492 - RNA, 9879 nt, Artificial Sequence
  derived and/or modified CDS sequence (opt2) from DENV-1__KC692495__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11493 - RNA, 9879 nt, Artificial Sequence
  derived and/or modified CDS sequence (opt2) from DENV-1__KC692496__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccuccucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11494 - RNA, 9879 nt, Artificial Sequence
  derived and/or modified CDS sequence (opt2) from DENV-1__KC692497__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaccggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacgucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11495 - RNA, 9879 nt, Artificial Sequence
  derived and/or modified CDS sequence (opt2) from DENV-1__KC692498__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaccggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuucuccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacgucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11496 - RNA, 9879 nt, Artificial Sequence
  derived and/or modified CDS sequence (opt2) from DENV-1__KC692499__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgucaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggaguacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucgccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11497 - RNA, 9879 nt, Artificial Sequence
  derived and/or modified CDS sequence (opt2) from DENV-1__KC692500__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaagggcaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuucaagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11498 - RNA, 9879 nt, Artificial Sequence
  derived and/or modified CDS sequence (opt2) from DENV-1__KC692501__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgaggagaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11499 - RNA, 9879 nt, Artificial Sequence
  derived and/or modified CDS sequence (opt2) from DENV-1__KC692502__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucguccgcaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgagauggagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccauguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucucccagguccgccgccucaucggcaacgagaacuaccucgacuacaugaccuccaugaagcgcuucaagaacgaguccgaccccgagggcgcccucugguga

SEQ ID NO: 11500 - RNA, 9879 nt, Artificial Sequence
  derived and/or modified CDS sequence (opt2) from DENV-1__KC692503__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggaccgccucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaucggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgaggagaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11501 - RNA, 9879 nt, Artificial Sequence
  derived and/or modified CDS sequence (opt2) from DENV-1__KC692504__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaugaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacgucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11502 - RNA, 9879 nt, Artificial Sequence
  derived and/or modified CDS sequence (opt2) from DENV-1__KC692508__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggagcacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11503 - RNA, 9879 nt, Artificial Sequence
  derived and/or modified CDS sequence (opt2) from DENV-1__KC692509__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucguccgcaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgagauggagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucucccagguccgccgccucaucggcaacgagaacuaccucgacuacaugaccuccaugaagcgcuucaagaacgaguccgaccccgagggcgcccucugguga

SEQ ID NO: 11504 - RNA, 9879 nt, Artificial Sequence
  derived and/or modified CDS sequence (opt2) from DENV-1__KC692510__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11505 - RNA, 9879 nt, Artificial Sequence
  derived and/or modified CDS sequence (opt2) from DENV-1__KC692511__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaacugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacaucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccaacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11506 - RNA, 9879 nt, Artificial Sequence
  derived and/or modified CDS sequence (opt2) from DENV-1__KC692512__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgaggagaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacuccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcaccgcuccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11507 - RNA, 9879 nt, Artificial Sequence
  derived and/or modified CDS sequence (opt2) from DENV-1__KC692513__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccccccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacaucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcuccgagaacuaccucgacuacaugaccuccaugaagcgcuucaagaacgaguccgaccccgagggcgcccucugguga

SEQ ID NO: 11508 - RNA, 9879 nt, Artificial Sequence
  derived and/or modified CDS sequence (opt2) from DENV-1__KC692514__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11509 - RNA, 9879 nt, Artificial Sequence
  derived and/or modified CDS sequence (opt2) from DENV-1__KC692515__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcggcaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgaggagaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacuccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcaccgcuccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11510 - RNA, 9879 nt, Artificial Sequence
  derived and/or modified CDS sequence (opt2) from DENV-1__KC692516__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacaacuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccucccucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccugcgucaagaaggaccucaucuccuacggcggcggcuggcgcuuccagggccucuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucucccgcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaagcaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11511 - RNA, 9879 nt, Artificial Sequence
  derived and/or modified CDS sequence (opt2) from DENV-1__KC692517__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaucgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccccccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaaguccgucaacaucgagaccgagccccccuucggcgaguccuacaucgucgucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaacccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccaaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucguccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11512 - RNA, 9879 nt, Artificial Sequence
  derived and/or modified CDS sequence (opt2) from DENV-1__KC762649__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcgccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucuccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaucuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11513 - RNA, 9879 nt, Artificial Sequence
  derived and/or modified CDS sequence (opt2) from DENV-1__KC762625__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucuccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaaguccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11514 - RNA, 9879 nt, Artificial Sequence
  derived and/or modified CDS sequence (opt2) from DENV-1__KC762635__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11515 - RNA, 9879 nt, Artificial Sequence
  derived and/or modified CDS sequence (opt2) from DENV-1__KC762650__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccaucgaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11516 - RNA, 9879 nt, Artificial Sequence
  derived and/or modified CDS sequence (opt2) from DENV-1__KC762623__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucuccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaaguccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuuccucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11517 - RNA, 9879 nt, Artificial Sequence
  derived and/or modified CDS sequence (opt2) from DENV-1__KC762632__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagaugcagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaucaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgaccagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11518 - RNA, 9879 nt, Artificial Sequence
  derived and/or modified CDS sequence (opt2) from DENV-1__KC762637__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11519 - RNA, 9879 nt, Artificial Sequence
  derived and/or modified CDS sequence (opt2) from DENV-1__KC762620__SS-prME
uccgucaccaugcucuucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaucgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagcgcggcgucauccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcaacaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacaaccagcgcgccuggaacaucugggaggucgaggacuacggcuucggcgucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgagcgcgccuccuucaucgaggucaagaccugcaucuggccccgcucccacacccucugguccaacggcguccucgaguccgagaugaucauccccaagaccuacggcggccccgucucccagcacaacuaccgccccggcuacuucacccagaccgccggccccuggcaccucggcaagcucgagcucgacuucgaccucugcgagggcaccaccgucgucgucgacgagaacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcugguccggcaagaugcucaugaccggcacccucgccgucuuccuccuccucaccaugggccagcucaccuggaacgaccucauccgccucugcaucauggucggcgccaacgccuccgacaugaugggcaugggcaccaccuaccucgcccucauggccaccuuccgcaugcgccccauguucgccgucggccuccucuuccgccgccucaccucccgcgagguccuccuccucaccgucggccucucccucgccgccuccgucgagcuccccaacucccucgaggagcucggcgacggccucgccaugggcaucaugaugcucaagcuccucaccgacuuccagucccaccagcucugggccacccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccaugcuccucaucaccgagaacaagaucuggggccgccgcuccuggcccaucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggacgaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccauccuccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaacuccaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaaccucuacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucaucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11520 - RNA, 9879 nt, Artificial Sequence
  derived and/or modified CDS sequence (opt2) from DENV-1__KC762631__SS-prME
uccgucaccaugcuccucaugcucaugcccaccgcccucgccuuccaccucaccacccgcggcggcgagccccacaugaccgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaaccucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaaccucggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgagaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggagcucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11521 - RNA, 9879 nt, Artificial Sequence
  derived and/or modified CDS sequence (opt2) from DENV-1__KC762621__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11522 - RNA, 9879 nt, Artificial Sequence
  derived and/or modified CDS sequence (opt2) from DENV-1__KC762643__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcguccucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucauccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaaggcccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11523 - RNA, 9879 nt, Artificial Sequence
  derived and/or modified CDS sequence (opt2) from DENV-1__KC762651__SS-prME
uccgucaccaugcucuucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagcgcggcgucauccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacaaccagcgcgccuggaacaucugggaggucgaggacuacggcuucggcgucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgagcgcgccuccuucaucgaggucaagaccugcaucuggccccgcucccacacccucugguccaacggcguccucgaguccgagaugaucauccccaagaccuacggcggccccgucucccagcacaacuaccgccccggcuacuucacccagaccgccggccccuggcaccucggcaagcucgagcucgacuucaaccucugcgagggcaccaccgucgucgucgacgagaacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcugguccggcaagaugcucaugaccggcacccucgccgucuuccuccuccucaccaugggccagcucaccuggaacgaccucauccgccucugcaucauggucggcgccaacgccuccgacaugaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccacccuccucucccucaccuucgucaagaccgccuucucccuccacuacgccuggaagaccauggccaugauccucuccaucgucucccucuucccccucugccucuccaccaccucccagaagaccaccuggcuccccguccuccucggcucccucggcugcaagccccucaccaugcuccucaucaccgagaacaagaucuggggccgccgcuccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggacgaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccauccuccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccccaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaaccucuacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccaagcgcguccucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucaucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccuccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11524 - RNA, 9879 nt, Artificial Sequence
  derived and/or modified CDS sequence (opt2) from DENV-1__KC762653__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcuaccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcaugaucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgaggucaacggcauccucgcccagggcaagaagaugauccgcccccagcccauggagcacaaguacuccuggaaguccuggggcaaggccaaggucaucggcgccgacguccagaacaccaccuucaucaucgacggccccaacacccccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgagcucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaagaugggcaugggcaccaccuaccucgcccucauggccaccuuccgcaugcgccccaugcucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccgcccuccucucccucaccuucgucaagaccacccucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagaaggccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucaucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucacccccuccgagcucgagacccccaaccucgccgagcgcguccucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11525 - RNA, 9879 nt, Artificial Sequence
  derived and/or modified CDS sequence (opt2) from DENV-1__KC762640__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgaggucaacggcauccucgcccagggcaagaagaugauccgcccccagcccauggagcacaaguacuccuggaaguccuggggcaaggccaaggucaucggcgccgacguccagaacaccaccuucaucaucgacggccccaacacccccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgagcucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaagaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccgcccuccucucccucaccuucgucaagaccacccucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagaaggccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaccccccccgagaagugcgacacccuccucugcgacaucggcgaguccucccccaaccccaccaucgaggagggccgcacccuccgcguccuccgcauggucgagcccuggcuccgcggcaaccaguucugcaucaagguccucaaccccuacaugcccuccgucaucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgagaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucacccccuccgagcucgagacccccaaccucgccgagcgcguccucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11526 - RNA, 9879 nt, Artificial Sequence
  derived and/or modified CDS sequence (opt2) from DENV-1__KC762645__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccguccagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11527 - RNA, 9879 nt, Artificial Sequence
  derived and/or modified CDS sequence (opt2) from DENV-1__KC762628__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgaggucaacggcauccucgcccagggcaagaagaugauccgcccccagcccauggagcacaaguacuccuggaaguccuggggcaaggccaaggucaucggcgccgacguccagaacaccaccuucaucaucgacggccccaacacccccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgagcucugcgagggcaccaccgucgucgucgacgagcacugcggcucccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcauguccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaagaugggcaugggcaccacccaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccgcccuccucucccucaccuucgucaagaccacccucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccaucgaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccuccgcauggucgagcccuggcuccgcggcaaccaguucugcaucaagguccucaaccccuacaugcccuccgucaucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucacccccuccgagcucgagacccccaaccucgccgagcgcguccucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11528 - RNA, 9879 nt, Artificial Sequence
  derived and/or modified CDS sequence (opt2) from DENV-1__KC762624__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11529 - RNA, 9879 nt, Artificial Sequence
  derived and/or modified CDS sequence (opt2) from DENV-1__KC762644__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucgagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11530 - RNA, 9879 nt, Artificial Sequence
  derived and/or modified CDS sequence (opt2) from DENV-1__KC762630__SS-prME
uccgucaccguccucuucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaucaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucauccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacaaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccgucucccagcacaacuaccgccccggcuacuucacccagaccgccggccccuggcaccucggcaagcucgagcucgacuucgaccucugcgagggcaccaccgucgucgucgacgagaacugcggcaaccgcggccccucccuccgcaccaccaccgucaccggcaagaccauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccagcucaccuggaacgaccucauccgccucugcaucauggucggcgccaacgccuccgacaugaugggcaugggcaccaccuaccucgcccucauggccaccuuccgcaugcgccccauguucgccgucggccuccucuuccgccgccucaccucccgcgagauccuccuccucaccgucggccucucccucgucgccuccgucgagcuccccaacucccucgaggagcucggcgacggccucgccaugggcaucaugaugcucaagcuccucaccgacuuccagccccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgccgcuccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggacgaggccgagcacuccggcgccucccacaacauccucgucgagguccaggacgacggcaccaugaagaucaaggacgaggagcgcgacgacacccucaccauccuccucaaggccacccuccucgucaucuccggcgucuaccccauguccguccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgagaucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggucucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccccaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccucaaggcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucaucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccggcaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgucuucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11531 - RNA, 9879 nt, Artificial Sequence
  derived and/or modified CDS sequence (opt2) from DENV-1__KC762641__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucaccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11532 - RNA, 9879 nt, Artificial Sequence
  derived and/or modified CDS sequence (opt2) from DENV-1__KC762648__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11533 - RNA, 9879 nt, Artificial Sequence
  derived and/or modified CDS sequence (opt2) from DENV-1__KC762622__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucauggcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaccucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucauccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaaggcccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11534 - RNA, 9879 nt, Artificial Sequence
  derived and/or modified CDS sequence (opt2) from DENV-1__KC762629__SS-prME
uccgucaccaugcuccucaugcucaugcccaccgcccucgccuuccaccucaccacccgcggcggcgagccccacauggucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaagacccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcggcaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11535 - RNA, 9879 nt, Artificial Sequence
  derived and/or modified CDS sequence (opt2) from DENV-1__KC762627__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaugaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagaccuccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11536 - RNA, 9879 nt, Artificial Sequence
  derived and/or modified CDS sequence (opt2) from DENV-1__KC762647__SS-prME
uccgucaccaugcuccucaugcucacccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacucccgcgccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagcccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11537 - RNA, 9879 nt, Artificial Sequence
  derived and/or modified CDS sequence (opt2) from DENV-1__KC762639__SS-prME
uccgucaccaugcuccucaugcucacccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacucccgcgccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcgucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagaaggcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccacccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11538 - RNA, 9879 nt, Artificial Sequence
  derived and/or modified CDS sequence (opt2) from DENV-1__KC762642__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccacccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaucaccggcacccucgccgucuucuuccuccucaucaugggccaggucaccuggaacgaccucacccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaaguacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccgucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucuacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11539 - RNA, 9879 nt, Artificial Sequence
  derived and/or modified CDS sequence (opt2) from DENV-1__JQ915077__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccauccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaccgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11540 - RNA, 9879 nt, Artificial Sequence
  derived and/or modified CDS sequence (opt2) from DENV-1__JQ915079__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccaccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagcgccccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaugggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacaccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagucccaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggaggaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11541 - RNA, 9879 nt, Artificial Sequence
  derived and/or modified CDS sequence (opt2) from DENV-1__JQ915080__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccaccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagcgccccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaugggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaucauccucaccgucgccgccaacgagaugggccuccucgagaccaccaagaaggaccucggcaucggccacaccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagucccaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggaggaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11542 - RNA, 9879 nt, Artificial Sequence
  derived and/or modified CDS sequence (opt2) from DENV-1__KJ755855__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcgccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucgagcucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcgagcucuucggcaagggcucccuccucaccugcgccaaguucaagugcgucaccaagcucgagggcaagaucguccaguacgagaaccucaaguacuccgucaucgucaccguccacaucgccgcccagcaccaggucggcaacgaguccaccgagcacggcaccaccgccaucaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccucuuccuccucgucaccuucaagaccgcccacgccaagaagcaggaggucgucguccucggcucccaggagggcgccaugcacaccgcccucaccggcgccaccgcccuccagaccuucggcaccaccaccaucuucgccggccaccucaacauccgccucaagauggacaagcucacccucaagggcauguccuacgucaugugcaccggcuccuucaagcucgagaaggaggucgccgagacccagcacggcaccauccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgaccucaaguucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuacggcggccccaucucccagcacaacuacucccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgucucccucucccucggccuccucugcaucuccaucaugaucgaggaggucaugcgcucccgcuggucccgcaagaugcucaugaccggcacccucgccgucuucuuccgcaagauccgcggccagcucaccuggaacgaccucauccgccucugcaucauggucggcgccaacgccuccgaccgcaugggcacccgcaccaccuaccucgcccucauggccaccuucaagaugcgccccauguucuccgucggccuccucuuccgccgccucaccucccgcgagguccuccuccucaccaucggccucucccucgucgccuccgucgagcuccccaacucccucgaggagcucggcguccuccucgccaugggcaucaugauccucacccuccucaccgacuuccagucccaccagcucugggccacccuccucuccaugaccuucaucaagaccaccuucucccuccacuacaccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagaaggccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccuggggccgcgucaagaaggaccucaucuccuacggcggcggcuggggccucaagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccacgccaaggccucccaggagggcccccuccccgagaccgaggucgaggccuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccucccucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccccgccgaccgcgucaucgacccccgccgcugccucaaccccgucauccucaaggacggccccgagcgcgucauccucgccggccccaugcccgucaccgucgccuccgccaaccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgagaagaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaaggccggcaacggccuccucugcgucauggccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucauccgccuccucuucaugauccucaccgucgccgccaacgagaugggccuccucgagaccaccaagaaggaccucggcaucggccacgccgccgucgagaaccaccaccacgccgccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcuuccucucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucuccccccucugggagggcucccccggcaaguccuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaagaccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucuccgagguccgcggcuacaccaagggcggccccggccacgaggagcccauccccauggccaccuacggcugggaccuccucaagcgcugcuccggcaaggaguucuucuucaucccccccgagaagugcgacuccuuccucggcgacaucggcgaguccucccccaaccccaccaucgaggagggccgcaccguccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucgucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11543 - RNA, 9879 nt, Artificial Sequence
  derived and/or modified CDS sequence (opt2) from DENV-1__KF289073__SS-prME
uccgucaccaugcucuucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaagaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcguccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccaccgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaugggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcaagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaaggcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccaccacgccaccaugcucgacgucgaccuccgccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccaccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucaugggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11544 - RNA, 9879 nt, Artificial Sequence
  derived and/or modified CDS sequence (opt2) from DENV-1__JQ915072__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccaccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggccaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaugggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacaccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcucccgccgcggcaccggcgcccagggcgagacccucggcgagaaguggaagcgccagcucaaccagcucuccaaguccgaguucaacaucuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggaggaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaagcagguccgccgccucaucggcaacgagaacuaccucgacuacaugaccuccaugaagcgcuucaagaacgaguccgaccccgagggcgcccucugguga

SEQ ID NO: 11545 - RNA, 9879 nt, Artificial Sequence
  derived and/or modified CDS sequence (opt2) from DENV-1__JQ915071__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgccaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccaccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagcgccccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccuccgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacaccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggcccgcgagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggaggaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11546 - RNA, 9879 nt, Artificial Sequence
  derived and/or modified CDS sequence (opt2) from DENV-1__JQ915073__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcuuccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccaccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggccaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgccgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacaccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggaggaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11547 - RNA, 9879 nt, Artificial Sequence
  derived and/or modified CDS sequence (opt2) from DENV-1__JQ915075__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgccaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccaccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagcgccccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaucuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccuccgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccaacgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacaccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccauggccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggcccgcgagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggaggaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11548 - RNA, 9879 nt, Artificial Sequence
  derived and/or modified CDS sequence (opt2) from DENV-1__JQ915076__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccaccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggccaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaagaccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacaccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccgccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggaggaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccggccgcguccucgacuggcucgagaagcacggcaucgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11549 - RNA, 9879 nt, Artificial Sequence
  derived and/or modified CDS sequence (opt2) from DENV-1__KF289072__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgccgucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 11550 - RNA, 9879 nt, Artificial Sequence
  derived and/or modified CDS sequence (opt2) from DENV-1__JQ692085__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgccgucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugacccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccgucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccaacgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgacuccgagggcgcccucugguga

SEQ ID NO: 11551 - RNA, 9879 nt, Artificial Sequence
  derived and/or modified CDS sequence (opt2) from DENV-1__JQ917404__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggacccgcgagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11552 - RNA, 9879 nt, Artificial Sequence
  derived and/or modified CDS sequence (opt2) from DENV-1__GU370048__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucaacuucaacgagaugguccuccucaccaugaaggagaaguccuggcucguccacaagcagugguuccucgaccucccccuccccuggaccuccggcgccuccaccacccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacuccccccgccgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaucaccggcacccucgccgucuucuuccuccucaucaugggccaggucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagccccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucuacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11553 - RNA, 9879 nt, Artificial Sequence
  derived and/or modified CDS sequence (opt2) from DENV-1__KM403627__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaguccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11554 - RNA, 9879 nt, Artificial Sequence
  derived and/or modified CDS sequence (opt2) from DENV-1__KM403584__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagguccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccuacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggcaugaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11555 - RNA, 9879 nt, Artificial Sequence
  derived and/or modified CDS sequence (opt2) from DENV-1__KM403633__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugcgcgagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11556 - RNA, 9879 nt, Artificial Sequence
  derived and/or modified CDS sequence (opt2) from DENV-1__KM403592__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucgcccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucguccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccaugcccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11557 - RNA, 9879 nt, Artificial Sequence
  derived and/or modified CDS sequence (opt2) from DENV-1__KM403593__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucgcccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11558 - RNA, 9879 nt, Artificial Sequence
  derived and/or modified CDS sequence (opt2) from DENV-1__KM403603__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagacccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11559 - RNA, 9879 nt, Artificial Sequence
  derived and/or modified CDS sequence (opt2) from DENV-1__KM403585__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggccgcaucguccaguacgagaaccucaaguacuccgucaucgucaccguccacaccggcgaccagcaccaggucggcaacgagaccaccgagcacggcaccaucgccaccaucaccccccaggcccccaccuccgagguccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccuacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucgucgaggucgaccgcuccgaggccaaggagggcaugaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11560 - RNA, 9879 nt, Artificial Sequence
  derived and/or modified CDS sequence (opt2) from DENV-1__KM403595__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgaccgccgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaucgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccaucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaccgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11561 - RNA, 9879 nt, Artificial Sequence
  derived and/or modified CDS sequence (opt2) from DENV-1__KM403604__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcagggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11562 - RNA, 9879 nt, Artificial Sequence
  derived and/or modified CDS sequence (opt2) from DENV-1__KM403588__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagaugggcaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaucgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccauccgcgacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucgccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11563 - RNA, 9879 nt, Artificial Sequence
  derived and/or modified CDS sequence (opt2) from DENV-1__KM403605__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccauccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagacccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgaggucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11564 - RNA, 9879 nt, Artificial Sequence
  derived and/or modified CDS sequence (opt2) from DENV-1__KM403606__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccacccucgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagacccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11565 - RNA, 9879 nt, Artificial Sequence
  derived and/or modified CDS sequence (opt2) from DENV-1__KM403591__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagaugggcaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagaccaagcgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11566 - RNA, 9879 nt, Artificial Sequence
  derived and/or modified CDS sequence (opt2) from DENV-1__KM403607__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccauccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagacccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11567 - RNA, 9879 nt, Artificial Sequence
  derived and/or modified CDS sequence (opt2) from DENV-1__KM403581__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgaccgccgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagcucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccaucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11568 - RNA, 9879 nt, Artificial Sequence
  derived and/or modified CDS sequence (opt2) from DENV-1__KM403597__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgaccgccgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccaucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaucugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11569 - RNA, 9879 nt, Artificial Sequence
  derived and/or modified CDS sequence (opt2) from DENV-1__KM403610__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccauccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccuccgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcugguccaagaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11570 - RNA, 9879 nt, Artificial Sequence
  derived and/or modified CDS sequence (opt2) from DENV-1__KM403596__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgaccgccgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucucccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaucgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccaucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaccgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11571 - RNA, 9879 nt, Artificial Sequence
  derived and/or modified CDS sequence (opt2) from DENV-1__KM403616__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucgucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgccuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11572 - RNA, 9879 nt, Artificial Sequence
  derived and/or modified CDS sequence (opt2) from DENV-1__KM403617__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucgucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11573 - RNA, 9879 nt, Artificial Sequence
  derived and/or modified CDS sequence (opt2) from DENV-1__KM403635__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccgccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucgucggcaacgagaacuaccucgacuacaugaccuccaugaagcgcuucaagaacgaguccgaccccgagggcgcccucugguga

SEQ ID NO: 11574 - RNA, 9879 nt, Artificial Sequence
  derived and/or modified CDS sequence (opt2) from DENV-1__KM403621__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaguccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11575 - RNA, 9879 nt, Artificial Sequence
  derived and/or modified CDS sequence (opt2) from DENV-1__KM403623__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaguccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11576 - RNA, 9879 nt, Artificial Sequence
  derived and/or modified CDS sequence (opt2) from DENV-1__KM403575__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11577 - RNA, 9879 nt, Artificial Sequence
  derived and/or modified CDS sequence (opt2) from DENV-1__KM403586__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagguccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccuacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggccgcuucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggcaugaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11578 - RNA, 9879 nt, Artificial Sequence
  derived and/or modified CDS sequence (opt2) from DENV-1__KM403602__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgccaucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccuccgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcugguccaagaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11579 - RNA, 9879 nt, Artificial Sequence
  derived and/or modified CDS sequence (opt2) from DENV-1__KM403582__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgaccgccgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccaccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccaucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaccgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11580 - RNA, 9879 nt, Artificial Sequence
  derived and/or modified CDS sequence (opt2) from DENV-1__KM403577__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11581 - RNA, 9879 nt, Artificial Sequence
  derived and/or modified CDS sequence (opt2) from DENV-1__KM403631__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccaucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11582 - RNA, 9879 nt, Artificial Sequence
  derived and/or modified CDS sequence (opt2) from DENV-1__KM403632__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguuccgcugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11583 - RNA, 9879 nt, Artificial Sequence
  derived and/or modified CDS sequence (opt2) from DENV-1__KM403583__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgaccgccgcuccgucgcccucgccccccacgucggccucggccucgagacccgcaccgagaccuggauguccuccgagggcgccuggcgccagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccaucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11584 - RNA, 9879 nt, Artificial Sequence
  derived and/or modified CDS sequence (opt2) from DENV-1__KM403579__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucggcaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgcaagcucaucggcaacgagaacuaccucgacuacaugaccuccaugaagcgcuucaagaacgaguccgaccccgagggcgcccucugguga

SEQ ID NO: 11585 - RNA, 9879 nt, Artificial Sequence
  derived and/or modified CDS sequence (opt2) from DENV-1__HM469968__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcgcccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaaguacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11586 - RNA, 9879 nt, Artificial Sequence
  derived and/or modified CDS sequence (opt2) from DENV-1__KC172834__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccaggccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaaccucggccacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucauccuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucgucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggggccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11587 - RNA, 9879 nt, Artificial Sequence
  derived and/or modified CDS sequence (opt2) from DENV-1__KJ933413__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccaccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcacccucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucaccucccaggacgagaagggcgucacccagaacggccgccucaucaccgccaaccccaucgucaccgacaaggagaagcccgucaacaucgaggccgagccccccuucggcgaguccuaccucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucauccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgucacccgccucgagaacaucauguggaagcagaucuccaacgagcucaaccacauccuccucgagaacgacaugaaguucaccgucgucgucggcgacgucaacggcauccucgcccagggcaagaagaugauccgcccccagcccauggagcacaaguacuccuggaaguccuggggcaaggccaaggucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucacccgcgccuccuucaucgaggucaagaccugcgucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucggccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgaggagcucggcgacggccucgccaugggcaucaugaugcucaagcuccucaccgacuuccagucccaccagcucugggccgcccuccucucccucaccuucgucaagaccaccuucucccuccacuacgccuggaagaccauggccaugauccucuccaucgucucccucuucccccucugccucuccaccaccucccagaagaccaccuggcuccccguccuccucggcucccucggcugcaagccccucaccauguuccucaucaccgagaaccgcaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggcaagucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccauggaggccuucccccaguccaacgccgccauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagucccaccaccacgccgccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagguccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucaccaagaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagacccccaaccucgccgagcgcguccucgacuggcucgagaaguacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11588 - RNA, 9879 nt, Artificial Sequence
  derived and/or modified CDS sequence (opt2) from DENV-1__KU666942__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccaccgccaucggcaaggccugggaggagggcgucugcggcauccgcuccgccacccgccucgagaacaucauguggaagcagaucuccaacgagcucaaccacauccuccucgagaacggcaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuaccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccauggagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccaucgccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagugcgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgagaucauggagcccgagcacgcccagcucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggaugaaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11589 - RNA, 9879 nt, Artificial Sequence
  derived and/or modified CDS sequence (opt2) from DENV-1__KU666939__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccuggguccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugccucccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucaucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccuccuccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccaucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11590 - RNA, 9879 nt, Artificial Sequence
  derived and/or modified CDS sequence (opt2) from DENV-1__KU666940__SS-prME
uccgucaccaugcuccucaugcucacccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuaccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccaucgccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagugcgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgagaucauggagcccgagcacgcccagcucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggaugaaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11591 - RNA, 9879 nt, Artificial Sequence
  derived and/or modified CDS sequence (opt2) from DENV-1__KU666941__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucggcgccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuaccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccaucgccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccguccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccaucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagugcgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgagaucauggagcccgagcacgcccagcucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggaugaaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11592 - RNA, 9879 nt, Artificial Sequence
  derived and/or modified CDS sequence (opt2) from DENV-1__KC172835__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacgucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcuccgccuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaccauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaucggccagcucaccuggaacgaccucauccgccucuccaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagccccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccgcccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgacgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugguccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggaguccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucucccagguccgccgccucaucggcaacgagaacuaccucgacuacaugaccuccaugaagcgcuucaagaacgaguccgaccccgagggcgcccucugguga

SEQ ID NO: 11593 - RNA, 9879 nt, Artificial Sequence
  derived and/or modified CDS sequence (opt2) from DENV-1__EU848545__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcaccaucaucgccauggaccucggcgagcucugcgaggacaccaugaccuacaagugcccccgcaucaccaaggccgagcccgacgacgucgacugcuggugcaacgccaccgacaccugggucaccuacggcaccugcucccgcaccggcgagcaccgccgcgacaagcgcuccgucgcccucgccccccacgucggccucggccucgagacccgcgccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaagcccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccccccaggagaccuggaaccgcgaggaccuccucgucaccuucaagaccgcccacgccaagaagcaggaggucgucguccucggcucccaggagggcgccaugcacaccgcccucaccggcgccaccgagauccagaccuccggcaccaccaagaucuucgccggccaccucaagugccgccucaagaugaacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagaugcucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccgccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucacccagggccgcaagaugaucggcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgacccccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaacuaccgccccggcuacuccacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggacaaggaggagaaccucgucaagucccucgucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccgcccuccucucccucaccuucaucaagaccaccuucucccuccacuacgccuggaagaccgucgccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgagaucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccaucuccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcggcaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgcaaguggugcuucgacggcgagcgcaacaaccagguccucgaggagaacauggacgucgagaucuggaccaaggagggcgagcgcaagaagcuccgcccccgcuggcucgacgcccgcaccuacuccgacccccaggcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucugggucgccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaucgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccaucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccucgagggcgcccucugguga

SEQ ID NO: 11594 - RNA, 9879 nt, Artificial Sequence
  derived and/or modified CDS sequence (opt2) from DENV-1__KR024708__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaguccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11595 - RNA, 9879 nt, Artificial Sequence
  derived and/or modified CDS sequence (opt2) from DENV-1__KR024705__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacgccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11596 - RNA, 9879 nt, Artificial Sequence
  derived and/or modified CDS sequence (opt2) from DENV-1__KR024706__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccggcgccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucggcggcgaggcccgcaagaccuucgucgagcucaugaagcgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcucguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11597 - RNA, 9879 nt, Artificial Sequence
  derived and/or modified CDS sequence (opt2) from DENV-1__KR024707__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucacccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11598 - RNA, 9879 nt, Artificial Sequence
  derived and/or modified CDS sequence (opt2) from DENV-1__KC172829__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcaccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucgucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcuccgccuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaucggccagcucaccuggaacgaccucauccgccucuccaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagaccaccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuucuccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgacgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccaugguccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggaguccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgcccucgacuggcucgagaagcacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucucccagguccgccgccucaucggcaacgagaacuaccucgacuacaugaccuccaugaagcgcuucaagaacgaguccgaccccgagggcgcccucugguga

SEQ ID NO: 11599 - RNA, 9879 nt, Artificial Sequence
  derived and/or modified CDS sequence (opt2) from DENV-1__EU359008__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacacccucaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccacccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcgcccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccaggucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgccauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11600 - RNA, 9879 nt, Artificial Sequence
  derived and/or modified CDS sequence (opt2) from DENV-1__AY835999__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuuccucacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccgucggcggcgucuucaccuccgucggcaagcucguccaccagaucuucggcaccgccuacggcguccucuucuccggcgucuccuggaccaugaagcucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucguccagggcaagaagaugauccgcccccagcccauggaguacaaguacuccuggaaguccuggggcaaggccaagaucaucggcgccgacguccagaacuccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgagaacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcauccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccagaccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccauggaggccuucccccaguccaacgccgucauccaggacgaggagcgcgacauccccgagcgcuccuggaacuccggcuacgaguggaucaccgacuuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgcccuccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccagcucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11601 - RNA, 9879 nt, Artificial Sequence
  derived and/or modified CDS sequence (opt2) from DENV-1__KP686070__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccaucuccacccaggacgagaagggcgucacccagaacggccgccucaucaccgccaaccccaucgucaccgacaaggagaagcccgucaacaucgagaccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucacccagggcaagaagaugauccgcccccagcccauggagcacaaguacuccuggaaguccuggggcaaggccaagaucaucggcgccgacacccagaacaccaccuucaucaucgacggccccgacacccccgagugccccgacgaccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggccccgcucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucaaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggccuccucugcgucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgucuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgacuuccagucccaccagcucuggaccacccuccucucccucaccuucaucaagaccacccucucccucgacuacgccuggaagaccauggccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagcgcgccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgccgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgucgccgagaaccaccaccacgccaccaugcucgacaucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccgucuccaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaacaucgucaagcuccacuccggccgcgacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgagaucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgccccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagaacuccaaccucgccgagcgcguccucgacuggcucgagaagcacggcgucgagcgccucaagcgcauggccaucuccggcgacgacugcgucgucaagcccaccgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucaacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11602 - RNA, 9876 nt, Artificial Sequence
  derived and/or modified CDS sequence (opt2) from DENV-1__KF672760__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgagaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgccuucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagcgcggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacggccagcgcgccuggaacaucugggaggucgaggacuacggcuucggcgucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaccuggcccaagucccacacccucugguccaacggcguccucgaguccgagaugaucauccccaagaucuucggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaugaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccugcgucgagcuccccaacucccucgaggagcucggcgacggccucgccaugggcaucaugaugcucaagcuccucaccgaguuccagccccaccagcucuggaccacccuccucucccucaccuucgucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggagcaggaggccgagcacuccggcgccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggcuacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcgcaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccacccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcgcccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccgccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugg

SEQ ID NO: 11603 - RNA, 9876 nt, Artificial Sequence
  derived and/or modified CDS sequence (opt2) from DENV-1__KF672759__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgucggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccaggucaaguacgagggcaccgacgcccccugcaagauccccuuccucacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggccucuucaccuccgucggcaagcucauccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaacuacauccuccucgagaacgacaugaaguucaccgucgucgucggcgacgucaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgaccagcgcgccuggaacaucugggaggucgaggacuacggcuucggcaucuucaccaccaacaucuggcucaagcuccgcgacucccacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagauggucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcuaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccauccucaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccugccgcgagguccuccuccucaccgucggccucucccucgucgccuccgucgagcuccccaacucccucgaggagcucggcgacggccucgccaugggcaucaugaugcucaagcuccucaccgacuuccagccccaccagcucuggaccacccuccucucccucaccuucauccgcaccucccucucccucgacuacgccuggaagaccauggccauggcccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggcccaucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccaaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccacccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggagggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucaccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagaaguccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaaguccggcaccgucauggacgucaucucccgccgcgaccagcgcggcuccggccaggucggcaccuacggccucaacaccuucaccaacauggagguccagcucauccgccagauggaguccgagggcaucuucucccccuccgagcucgagacccccaaccucgccaagaagguccucgacuggcucgagaagcacggcgccgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugg

SEQ ID NO: 11604 - RNA, 9876 nt, Artificial Sequence
  derived and/or modified CDS sequence (opt2) from DENV-1__KF672761__SS-prME
uccgucaccaugcucuucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcggccaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugg

SEQ ID NO: 11605 - RNA, 9876 nt, Artificial Sequence
  derived and/or modified CDS sequence (opt2) from DENV-1__KF672762__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaucgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagguccucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgccaacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggccgcaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccgccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuuccuccccuccgagcucgagacccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccaucgacuggguccccaccucccgcaccaccugguccauccacgcccaccaccaguggaugaccaccgaggacaugcucuccgucuggaaccgcgucuggaucgaggagaaccccuggauggaggacaaggcccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugg

SEQ ID NO: 11606 - RNA, 9879 nt, Artificial Sequence
  derived and/or modified CDS sequence (opt2) from DENV-1__JF459993__SS-prME
uccgucaccaugcucuucaugcuccuccccaccucccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccucggccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuucuccucccaggacgagaagggcgucauccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacgccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucugguccaacggcguccucgaguccgagaugaucauccccaagaucuacggcggccccaucucccagcacaaccaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgcccucgaggagcuccccgacaccaucgagacccucaugcuccucgcccucaucgccguccucaccggcggcgucacccucuucuuccucuccggccgcggccucggcaagaccuccaucggccuccucugcgucauggccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccuccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgaggagaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgaggucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11607 - RNA, 9876 nt, Artificial Sequence
  derived and/or modified CDS sequence (opt2) from DENV-1__KF672763__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccgacggcauccucgcccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucguccgcuccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucauggccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacgagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccgcaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugg

SEQ ID NO: 11608 - RNA, 9876 nt, Artificial Sequence
  derived and/or modified CDS sequence (opt2) from DENV-1__KF672764__SS-prME
uccgucaccaugcuccucaugcuccuccccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaagaacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaccuccuacgucaugugcaccggcuccuucaagcucgagaaggaggucgccgagacccagcacggcaccguccucguccaggucaaguacgagggcaccgacgcccccugcaagauccccuucuccacccaggacgagaagggcgucacccagaacggccgccucaucaccgccaaccccaucgucaccgacaaggagaagcccgucaacaucgagaccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccaggucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggccgcgccugggaggagggcgucugcggcauccgcuccgccacccgccucgagaacaucauguggaagcagaucuccaacgagcucaaccacauccuccucgagaacgacaucaaguucaccgucgucgucggcaacgccaacggcauccucacccagggcaagaagaugauccgcccccagcccauggagcacaaguacuccuggaaguccuggggcaaggccaagaucaucggcgccgacauccagaacaccaccuucaucaucgacggccccgacacccccgagugccccgacgagcagcgcgccuggaacaucugggaggucgaggacuacggcuucggcaucuucaccaccaacaucuggcucaagcuccgcgacuccuacacccagaugugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagauguacggcggccccaucucccagcacaacuaccgccccggcuacuucacccagaccgccggccccuggcaccucggcaagcucgagcucgacuucgaccucugcgagggcaccaccgucgucgucgacgagcacugcggcucccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggcauccucugcgucuccaucaugaucgaggaggucaugcgcucccgcuggucccgcaagaugcucaugaccggcacccucgccgucuuccuccuccucaucaugggccagcucaccuggaacgaccucauccgccucugcaucauggucggcgccaacgccuccgacaagaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugaugcucaagcuccucaccgaguuccagccccaccagcucuggaccacccuccucucccucaccuucaucaagaccacccucucccucgacuacgccuggaagaccaccgccaugguccucuccaucgucucccucuucccccucugccucuccaccaccucccagaagaccaccuggcuccccguccuccucggcuccuucggcugcaagccccucaccauguuccucaucaccgagaacaagaucuggggccgcaaguccuggccccucaacgagggcaucauggccaucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcaccucccacaacauccucgucgagguccaggacgacggcaccaugaagaucaaggacgaggagcgcgacgacacccucaccauccuccucaaggccacccuccucgccgucuccggcgucuaccccauguccauccccgccacccucuucgucugguacuucuggcagaagaagaagcagcgcuccggcguccucugggacacccccuccccccccgaggucgagcgcgccguccucgacgacggcaucuaccgcauccuccagcgcggccuccucggccgcucccaggucggcgucggcgucuuccaggacggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuucaagaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggccgcgagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccuccgcgcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucaccgccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgccgagaaccaccagcacgccaccaugcucgacgucgaccuccaccccgccuccgccuggacccucuacgccgucgccaccaccgucaucacccccaugaugcgccacaccaucgagaacaccaccgccaacaucucccucaccgccaucgccaaccaggccgccauccucaugggccucgacaagggcuggcccaucuccaagauggaccucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcaccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaugccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcaccccccgcgccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggagguccagcucauccgccagauggaguccgagggcaucuucuuccccuccgagcucgagucccccaaccucgccgagcgcguccucgacuggcucgagaagcacggcgccgagcgccucaagcgcauggccaucuccggcgacgacugcgucgucaagcccaucgacgaccgcuucgccaccgcccucaucgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggagguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugg

SEQ ID NO: 11609 - RNA, 9879 nt, Artificial Sequence
  derived and/or modified CDS sequence (opt2) from DENV-1__EU863650__SS-prME
uccgucaccaugcuccucaugcuccuccccaccguccucaccuuccaccucaccacccgcggcggcgagccccacaugaucgucuccaagcaggagcgcggcaagucccuccucuucaagaccuccgccggcgucaacaugugcacccucaucgccauggaccucggcgagcucugcgacgacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggcgccagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaucgccaccaucaccccccaggcccccaccuccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcaucuccuacgucaugugcaccggccucuucaagcucgagaaggaggucgccgagacccagcacggcaccguccucguccaggucaaguacgagggcaccgacgcccccugcaagauccccuucuccucccaggacgagaagggcgccacccagaacggccgccucgucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaccauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcgucuggcccaagucccacacccucuggucccacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuucaagggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgucgucuuccuccuccucacccucggccagcucaccuggaacgaccucauccgccucugcaucauggucggcgccaacgccuccgacaacaugggcaugggcaccaccuaccucgcccucauggccaccuuccgcaugcgccccauguucgccgucggccuccucuuccgccgccucaccucccgcgagguccuccuccucaccgucggccucucccucgucgccuccgucgagcuccccaacucccucgacgagcucggcgacggccucgccaugggcaucaugauccucaagcuccucaccgacuuccagucccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccaaggucuccugggaggaggaggccgagcacuccggcgccucccacaacauccucgucgagauccaggacgacggcaccaugaagaucaaggacgaggagcgcgacgacaccaucaccauccuccucaaggccacccuccucgccaucuccggcgucuaccccauguccauccccgccacccucuucgucuggcacuucuggcagaagaagaagcagcgcuccggcguccucugggacacccccuccccccccgaggucgagaaggccguccucgacgacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccgcccccggcaccuucaagaccuccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagaaggacauccccgagcgcuccuggaacuccggcuacgacuggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccagaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaaggcccucgacaaccucgucaugcuccacaacuccgagcagggcggcaaggccuaccgccacgccauggaggagcuccccgacaccaucgagaccaucaugcuccucgcccucaucgccguccucaccggcggcgucacccucuucuuccucuccggccgcggccucggcaagaccuccaucggccuccucugcgucaccuccuccuccgcccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaccgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaagaccuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuccaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacucccccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuuccuccccuccgagcucgagccccccaaccucgccggccgcguccccgacuggcucgagaagcacggcaccgagcgccuccgccgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11610 - RNA, 9879 nt, Artificial Sequence
  derived and/or modified CDS sequence (opt2) from DENV-1__KU365900__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggccccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccuccuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucucccucaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgcaaguggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccaccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcucuacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagaaggacgucgaccucggcgccggcacccgccacgucgccgucgagcccgaggucgccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucaucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagaucuccggcggcaacauguacgccgacgacaccgccggcugggacacccgcaucaccgaggacgaccuccagaacgaggccaagaucaccgacaucauggagcccgagcacgcccuccucgccaaggccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucggcaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga

SEQ ID NO: 11611 - RNA, 9879 nt, Artificial Sequence
  derived and/or modified CDS sequence (opt2) from DENV-1__FJ176779__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucgucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgucggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggagcacaaguacuccuggaagaacuggggcaaggccaagaucaucggcgccgacguccagaacuccaccuucaucaucgacggccccaacacccccgagugcuccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaacucccucgaggagcucggcgacggccucgccaugggcaucaugauccucaagcuccucaccgacuuccagucccaccagcucugggccacccuccucuccaugaccuucaucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgcaaguccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccaaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagaugcgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgaguuccccggcaagaccgucugguucguccccuccaucaaggccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggcaagggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccaucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucaccaaccucgacaucaucggccagcgcaucgagaacaucaaguacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucugguccuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgaccgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccaacgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccgcaucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuacuccgacuacaugaccuccaugaagcgcuucaagaacgaguccgagcccgagggcgcccucugguga

SEQ ID NO: 11612 - RNA, 9879 nt, Artificial Sequence
  derived and/or modified CDS sequence (opt2) from DENV-1__FJ176780__SS-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucgccggcauccucgcccagggcaagaagaugauccgcccccagcccauggaguacaaguacuccuggaaguccuggggcaaggccaagaucaucggcgccgacguccagaacaccaccuucaucaucgacggccccaacacccccgagugccccgacgaccagcgcgccuggaacaucugggaggucgaggacuacggcuucggcaucuucaccaccaacaucuggcucaagcuccgcgacuccuacacccaggucugcgaccaccgccucauguccgccgccaucaaggacuccaaggccguccacgccgacaugggcuacuggaucgaguccgagaagaacgagaccuggaagcucgcccgcgccuccuucaucgaggucaagaccugcaucuggcccaagucccacacccucugguccaacggcguccucgaguccgagaugaucauccccaagaucuacggcggccccaucucccagcacaacuaccgccccggcuacuucacccagaccgccggccccuggcaccucggcaagcucgagcucgacuucgaccucugcgagggcaccaccgucgucgucgacgagcacugcggcaaccgcggccccucccuccgcaccaccaccgucaccggcaagaucauccacgaguggugcugccgcuccugcacccuccccccccuccgcuuccgcggcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuucuuccuccucaucaugggccagcucaccuggaacgaccucauccgccucugcaucauggucggcgccaacgccuccgaccgcaugggcaugggcaccaccuaccucgcccucauggccaccuucaagaugcgccccauguucgccgucggccuccucuuccgccgccucaccucccgcgagguccuccuccucaccaucggccucucccucgucgccuccgucgagcuccccaccucccucgaggagcucggcgacggccucgccaugggcaucaugauccucaagcuccucaccgacuuccagucccaccagcucugggccacccuccucucccucaccuucgucaagaccaccuucucccuccacuacgccuggaagaccauggccaugguccucuccaucgucucccucuucccccucugccucuccaccaccucccagaagaccaccuggcuccccguccuccucggcucccucggcugcaagccccucaccauguuccucaucgccgagaacaagaucuggggccgccgcuccuggccccucaacgagggcaucauggccgucggcaucgucuccauccuccucuccucccuccucaagaacgacgucccccucgccggcccccucaucgccggcggcaugcucaucgccugcuacgucaucuccggcuccuccgccgaccucucccucgagaaggccgccgaggucuccugggaggaggaggccgagcacuccggcgccucccacaacauccucgucgagguccaggacgacggcaccaugaagaucaaggacgaggagcgcgacgacacccucaccauccuccucaaggccacccuccucgccgucuccggcgucuacccccucuccauccccgccacccucuucgucugguacuucuggcagaagaagaagcagcgcuccggcguccucugggacacccccuccccccccgaggucgagcgcgccguccucgacgacggcaucuaccgcaucaugcagcgcggccuccucggccgcucccaggucggcgucggcgucuuccaggagaacgucuuccacaccauguggcacgucacccgcggcgccguccucauguaccagggcaagcgccucgagcccuccugggccuccgucaagaaggaccucaucuccuacggcggcggcuggcgccuccagggcuccuggaacaccggcgaggagguccaggucaucgccgucgagcccggcaagaaccccaagaacguccagaccgcccccggcaccuucaagacccccgagggcgaggucggcgccaucgcccucgacuucaagcccggcaccuccggcucccccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucauccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccuccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucauccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccacaacaaggagggcgaccaguacaucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuaccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccagcgcgcccagaacgcccucgacaaccucgucaugcuccacaacuccgagcagggcggccgcgccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgucgccgucgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccaggccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaaguucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaccuacaagcgcuccggcaucauggaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaucccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucaccaaccucgacaucaucggccagcgcaucgagaacaucaagcacgagcacaaguccaccuggcacuacgacgaggacaaccccuacaagaccugggccuaccacggcuccuacgaggucaagcccuccggcuccgccuccuccauggucaacggcgucgucaagcuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgccaaguggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggcaagcgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccuccacaagcucggcuacauccuccgcgacaucuccaagauccccggcggcaacauguacgccgacgacaccgccggcugggacacccgcaucaccgaggacgaccuccagaacgaggcccgcaucaccgacaucauggagcccgagcacgcccuccucgccaaguccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcguccucgacuggcucgagaaguacggcgucgagcgccucaagcgcauggccaucuccggcgacgacugcgucgucaagcccaucgacgaccgcuucgccaccgcccucaccgcccucaacgacaugggcaagguccgcaaggacaucccccagugggagcccuccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggauccccaccucccgcaccaccugguccauccacgcccaccaccaguggaugaccaccgaggacaugcucuccgucuggaaccgcgucuggaucgaggagaaccccuggauggaggacaagacccacaucuccuccuggggcgacguccccuaccucggcaagcgcgaggaccaguggugcggcucccucaucggccucaccgcccgcgccaccugggccaccaacauccaggucgccaucuaccagguccgccgccucaucggcaacgagaacuaccucgacuacaugaccuccaugaagcgcuucaagaacgaguccgaccccgagggcgcccucugguga

SEQ ID NO: 11613 - RNA, 9879 nt, Artificial Sequence
  derived and/or modified CDS sequence (opt2) from DENV-1__JN205310__SS-prME
uccgucaccguccucuucaugcuccuccccaccgcccucgccuuccaccucaccacccucggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgagaccgagcccgacgacgucgacugcuggugcaacgccaccgagaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagaaggucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcaaccgcgacuucgucgagggccccuccggcgccaccugggucgacgucguccucgagcacggcuccugcgucaccaccauggccaagaacaagcccacccucgacaucgagcuccucaagaccgaggucaccaaccccgccauccuccgcaagcucugcaucgaggccaagaucuccaacaccaccaccgacucccgcugccccacccagggcgaggccacccucgucgaggagcaggacaccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgagaccaccgagcacggcaccaccgccaucaucaccccccaggcccccaccuccgagauccagcucaccgacuacggcgcccucacccccgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcgucuccuacgucaugugcaccggcuccuucaagcucgagaaggaggucgccgagacccagcacggcaccguccucguccaggucaaguacgagggcaccgacgcccccugcaagauccccuccuccucccaggacgagaagggcgucauccagaacggccgccucaucaccgccaaccccaucgucaccgacaaggagaagcccgucaacaucgaggccgagccccccuucggcgaguccuacaucgucgucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcauccuccucaccuggcucggccucaacucccgcuccaccucccucuccaugaccugcaucgccgucggcauggucacccucuaccucggcgucaugguccaggccgacuccggcugcgucaucaacuggaagggccgcgagcucaagugcggcuccggcaucuucgucaccaacgagguccacaccuggaccgagcaguacaaguuccaggccgacucccccaagcgccucuccgccgccaucggcaaggccugggaggagggcgucugcggcauccgcuccgccacccgccucgagaacaucauguggaagcagaucuccaacgagcucaaccacauccuccucgagaacgacaugaaguucaccgucgucgucggcgacgucuccggcauccucgcccagggcaagaagaugauccgcccccagcccauggagcacaaguacuccuggaaguccuggggcaaggccaagaucaucggcgccgacguccagaacaccaccuucaucaucgacggccccaacacccccgagugccccgacaaccagcgcgccuggaacaucugggaggucgaggacuacggcuucggcaucuucaccaccaacaucuggcucaagcuccgcgacuccuucacccaggucugcgaccaccgccucauguccgccgccaucaaggacuccaaggccguccacgccgacaugggcuacuggaucgaguccgagaagaaggagaccuggaagcucgcccgcgccuccuucaucgaggucaagaccugcaucuggcccaagucccacacccucugguccaacggcguccucgaguccgagaugaucauccccaagaucuacggcggccccgucucccagcacaacuaccgccccggcuacuucacccagaccgccggccccuggcaccucggcaagcucgagcucgacuucgaccucugcgagggcaccaccgucgucgucgacgagaacugcggcaaccgcggccccucccuccgcaccaccaccgucaccggcaagaccacccacgagcgcugcugccgcuccugcacccuccccccccuccgcuucaagcgcgaggacggcugcugguacggcauggagauccgccccgucaaggagaaggaggagaaccucgucaaguccauggucuccgccggcuccggcgaggucgacuccuucucccucggccuccucugcaucuccaucaugaucgaggaggucaugcgcucccgcuggucccgcaagaugcucaugaccggcacccucgccgucuuccuccuccucaccaugggccaguccaccuggaacgaccucauccgccucugcaccauggucggcgccaacgccuccgacaugaugggcaugggcaccaccuaccucgcccucauggccaccuuccgcaugcgccccauguucgccgucggccuccucuuccgccgccucaccucccgcgagauccuccuccucaccgucggccucucccucgucgccuccgucgagcuccccaacucccucgaggagcucggcgacggccucgccaugggcaucaugaugcucaagcuccucaccgacuuccagccccaccagcucugggccacccuccucucccucaccuucgucaagaccacccucucccuccacuacgccuggaagaccauggccaugauccucuccaucgucucccuccucccccucugccucuccaccaccucccagaagaccaccuggcuccccguccuccucggcucccucggcugcaagccccucaccauguuccucaucaccgagaacaagaucuggggccgccgcuccuggccccucaacgagggcaucauggccaucggcaucgucuccauccuccucuccuccccccucaagaacgacgucccccucgccggcccccucaucgccggcggcaugcucaucgccugcuacgucaucuccggcuccuccgccgaccucucccucgagaaggccgccgaggucuccugggaggacgaggccgagcacuccggcgccucccacaacauccucgucgagguccaggacgacggcaccaugaagaucaaggacgaggagcgcgacgacacccucaccauccuccucaaggccacccuccucgucaucuccggcgucuaccccauguccauccccgccacccucuucgucugguacuucuggcagaagaagaagcagcgcuccggcguccucugggacacccccuccccccccgaggucgagcgcgccguccucgacaacggcaucuaccgcauccuccagcgcggccuccucggccgcucccaggucggcgucggcgucuuccaggagggcgucuuccacaccauguggcacgucacccgcggcgccguccucauguaccagggcaagcgccucgagcccuccugggccuccgucaagaaggaccucaucuccuacggcggcggcuggcgcuuccagggcuccuggaacaccggcgaggagguccaggucaucgccgucgagcccggcaagaaccccaagaacguccagaccacccccggcaccuucaagacccccgagggcgaggucggcgccaucgcccucgacuucaagcccggcaccuccggcuccaccaucgucaaccgcgagggcaagaucgucggccucuacggcaacggcgucgucaccaccuccggcaccuacgucuccgccaucgcccaggccaaggccucccaggagggcccccuccccgagaucgaggacgaggucuuccgcaagcgcaaccucaccaucauggaccuccaccccggcuccggcaagacccgccgcuaccuccccgccaucguccgcgaggccaucaagcgcaagcuccgcacccucguccucgcccccacccgcgucgucgccuccgagauggccgaggcccucaagggcaugcccauccgcuaccagaccaccgccgucaaguccgagcacaccggcaaggagaucgucgaccucaugugccacgccaccuucaccaugcgccuccucucccccguccgcguccccaacuacaacaugaucaucauggacgaggcccacuucaccgaccccgccuccaucgccgcccgcggcuacaucuccacccgcgucggcaugggcgaggccgccgccaucuucaugaccgccaccccccccggcuccgucgaggccuucccccaguccaacgccgucauccaggacgaggagcgcgacauccccgagcgcuccuggaacuccggcuacgaguggaucaccgacuuccccggcaagaccgucugguucguccccuccaucaaguccggcaacgacaucgccaacugccuccgcaagaacggcaagcgcgucguccagcucucccgcaagaccuucgacaccgaguaccagaagaccaagaacaacgacugggacuacgucgucaccaccgacaucuccgagaugggcgccaacuuccgcgccgaccgcgucaucgacccccgccgcugccucaagcccgucauccucaaggacggccccgagcgcgucauccucgccggccccaugcccgucaccgucgccuccgccgcccagcgccgcggccgcaucggccgcaaccccaacaaggagggcgaccaguacgucuacaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccuccgcggcgaggcccgcaagaccuucgucgagcucaugcgccgcggcgaccuccccgucuggcucuccuacaaggucgccuccgagggcuuccaguacuccgaccgccgcuggugcuucgacggcgagcgcaacaaccagguccucgaggagaacauggacgucgagaucuggaccaaggagggcgagcgcaagaagcuccgcccccgcuggcucgacgcccgcaccuacuccgacccccucgcccuccgcgaguucaaggaguucgccgccggccgccgcuccgucuccggcgaccucauccucgagaucggcaagcucccccagcaccucacccucaaggcccagaacgcccucgacaaccucgucaugcuccacaacuccgagcagggcggcaaggccuaccgccacgccauggaggagcuccccgacaccaucgagacccucaugcuccucgcccucaucgccguccucaccggcggcgucacccucuucuuccucuccggccgcggccucggcaagaccuccaucggccuccucugcgucauggccuccuccguccuccucuggauggccuccgucgagccccacuggaucgccgccuccaucauccucgaguucuuccucaugguccuccucauccccgagcccgaccgccagcgcaccccccaggacaaccagcucgccuacgucgucaucggccuccucuucaugauccucaccgucgccgccaacgagaugggccuccucgagaccaccaagaaggaccucggcaucggccacgccgccgccgagaaccaccaccacgccgccaugcucgacgucgaccuccaccccgccuccgccuggacccucuacgccgucgccaccaccaucaucacccccaugaugcgccacaccaucgagaacaccaccgccaacaucucccucaccgccaucgccaaccacgccgccauccucaugggccucgacaagggcuggcccaucuccaagauggacaucggcgucccccuccucgcccucggcugcuacucccaggucaacccccucacccucaccgccgccguccucaugcucgucgcccacuacgccaucaucggccccggccuccaggccaaggccacccgcgaggcccagaagcgcaccgccgccggcaucaugaagaaccccaccgucgacggcaucgucgccaucgaccucgaccccgucgucuacgacgccaagaucgagaagcagcucggccagaucaugcuccucauccucugcaccucccagauccuccucaugcgcaccaccugggcccucugcgaguccaucacccucgccaccggcccccucaccacccucugggagggcucccccggcaaguucuggaacaccaccaucgccgucuccauggccaacaucuuccgcggcuccuaccucgccggcgccggccucgccuucucccucaugaagucccucggcggcggccgccgcggcaccggcgcccagggcgagacccucggcgagaaguggaagcgccagcucaaccagcucuccaaguccgaguucaacaucuacaagcgcuccggcaucaucgaggucgaccgcuccgaggccaaggagggccucaagcgcggcgagaccaccaagcacgccgucucccgcggcaccgccaagcuccgcugguucgucgagcgcaaccucgucaagcccgagggcaaggucaucgaccucggcugcggccgcggcggcugguccuacuacugcgccggccucaagaaggucaccgaggucaagggcuacaccaagggcggccccggccacgaggagcccauccccauggccaccuacggcuggaaccucgucaagcuccacuccggcaaggacgucuucuucaccccccccgagaagugcgacacccuccucugcgacaucggcgaguccucccccaaccccaccaucgaggagggccgcacccuccgcguccucaagauggucgagcccuggcuccgcggcaaccaguucugcaucaagauccucaaccccuacaugcccuccgucgucgagacccucgagcagaugcagcgcaagcacggcggcaugcucguccgcaacccccucucccgcaacuccacccacgagauguacugggucuccugcggcaccggcaacaucgucuccgccgucaacaugaccucccgcaugcuccucaaccgcuucaccauggcccaccgcaagcccaccuacgagcgcgacgucgaccucggcgccggcacccgccacgucgccgucgagcccgaggucgccaaccucgacaucaucggccagcgcaucgagaacaucaagaacgagcacaaguccaccuggcacuacgacgaggacaaccccuacaagaccugggccuaccacggcuccuacgaggucaagcccuccggcuccgccuccuccauggucaacggcgucguccgccuccucaccaagcccugggacgucauccccauggucacccagaucgccaugaccgacaccacccccuucggccagcagcgcgucuucaaggagaaggucgacacccgcacccccaaggccaagcgcggcaccgcccagaucauggaggucaccgcccgcuggcucuggggcuuccucucccgcaacaagaagccccgcaucugcacccgcgaggaguucacccgcaagguccgcuccaacgccgccaucggcgccgucuucgucgacgagaaccaguggaacuccgccaaggaggccgucgaggacgagcgcuucugggaccucguccaccgcgagcgcgagcuccacaagcagggcaagugcgccaccugcgucuacaacaugaugggccgccgcgagaagaagcucggcgaguucggcaaggccaagggcucccgcgccaucugguacauguggcucggcgcccgcuuccucgaguucgaggcccucggcuucaugaacgaggaccacugguucucccgcgagaacucccucuccggcgucgagggcgagggccaccacaagcucggcuacauccuccgcgacaucuccaagauccccggcggcaacauguacgccgacgacaccgccggcugggacacccgcaucaccgaggacgaccuccagaacgaggccaagaucaccgacaucauggagcccgagcacgcccuccucgccaccuccaucuucaagcucaccuaccagaacaaggucguccgcguccagcgccccgccaagaacggcaccgucauggacgucaucucccgccgcgaccagcgcggcuccggccaggucggcaccuacggccucaacaccuucaccaacauggaggcccagcucauccgccagauggaguccgagggcaucuucucccccuccgagcucgagacccccaaccucgccgagcgcgucuucgacuggcucgagaagcacggcaucgagcgccucaagcgcauggccaucuccggcgacgacugcgucgucaagcccaucgacgaccgcuucgccaccgcccucaccgcccucaacgacaugggcaagguccgcaaggacaucccccagugggagccccccaagggcuggaacgacuggcagcagguccccuucugcucccaccacuuccaccagcucaucaugaaggacggccgcgagaucgucguccccugccgcaaccaggacgagcucgucggccgcgcccgcgucucccagggcgccggcuggucccuccgcgagaccgccugccucggcaaguccuacgcccagauguggcagcucauguacuuccaccgccgcgaccuccgccucgccgccaacgccaucugcuccgccguccccgucgacuggguccccaccucccgcaccaccugguccauccacgcccaccaccaguggaugaccaccgaggacaugcucuccgucuggaaccgcgucuggaucgaggagaaccccuggauggaggacaagacccacgucuccuccugggaggacguccccuaccucggcaagcgcgaggaccaguggugcggcucccucaucggccucaccgcccgcgccaccugggccaccaacauccaggucgccaucaaccagguccgccgccucaucggcaacgagaacuaccucgacuacaugaccuccaugaagcgcuucaagaacgaguccgaccccgagggcgcccucugguga
